United States Patent
Furness et al.

(10) Patent No.: US 6,673,549 B1
(45) Date of Patent: Jan. 6, 2004

(54) GENES EXPRESSED IN C3A LIVER CELL CULTURES TREATED WITH STEROIDS

(75) Inventors: L. Michael Furness, Suffolk (GB); Jenny L. Buchbinder, San Francisco, CA (US)

(73) Assignee: Incyte Corporation, Palo Alto, CA (US)

( * ) Notice: Subject to any disclaimer, the term of this patent is extended or adjusted under 35 U.S.C. 154(b) by 0 days.

(21) Appl. No.: 09/976,594

(22) Filed: Oct. 12, 2001

Related U.S. Application Data

(60) Provisional application No. 60/240,409, filed on Oct. 12, 2000.

(51) Int. Cl.[7] .................................................. C12Q 1/68
(52) U.S. Cl. ........................ 435/6; 435/7.1; 435/287.2; 536/23.1; 514/44
(58) Field of Search ........................ 536/23.1; 514/44; 435/6, 287.2, 7.1

(56) References Cited

U.S. PATENT DOCUMENTS 5,968,784 A * 10/1999 Spinella et al. ............ 435/91.1

OTHER PUBLICATIONS

AA706636, GENBANK Dec. 24, 1997.*

H08554, GENBANK, Jun. 23, 1995.*

Mickelson, J.K. et al., "Differential Expression and Release of CD54 Induced by Cytokines", *Hepatology*, 22:866–875 (1995).

Nagendra, A.R. et al., "CD18 integrin and CD54–dependent neutrophil adhesion to cytokine–stimulated human hepatocytes", *Am. J. Physiol.*, 272:G408–G416 (1997).

* cited by examiner

*Primary Examiner*—Ardin H. Marschel
*Assistant Examiner*—Carolyn L Smith
(74) *Attorney, Agent, or Firm*—Incyte Corporation

(57) ABSTRACT

The present invention relates to a combination comprising a plurality of cDNAs which are differentially expressed in human C3A liver cell cultures treated with steroids or synthetic steroid analogues and which may be used entirely or in part to detect metabolic and toxicological responses to treatment with steroids and steroid antagonists, to diagnose, to stage, to treat, or to monitor the treatment of a subject with an steroid responsive disorder.

7 Claims, No Drawings

GENES EXPRESSED IN C3A LIVER CELL CULTURES TREATED WITH STEROIDS

This application claims the benefit of provisional application, No. 60/240,409 filed Oct. 12, 2000.

CD-R 1 contains Table 4 formatted in tab-delimited ASCII text and the Sequence Listing formatted in plain ASCII text. The file containing Table 4 is entitled Pa41us~1.TXT, created on Oct. 12, 2001, and is 110 KB in size. The Sequence Listing is entitled Pa41us~2.TXT, created on Oct. 12, 2001, and is 2,965 KB in size.

CD-R 2 is an exact copy of CD-R 1. CD-R 2 is labeled with Identification No. PA-0041 US, Copy 2.

CD-R 3 contains the Computer Readable Form of the Sequence Listing in compliance with 37 C.F.R. §1.821(e), and specified by 37 C.F.R. §1.824. CD-R 3 is labeled with Identification No. PA-0041 US, copy 3.

The disclosure of Tables 1–25 and the Sequence Listing submitted as an electronic document on compact disc as described above are to be part of the permanent USPTO record of this patent application and are hereby expressly incorporated by reference.

FIELD OF THE INVENTION

The present invention relates to a combination comprising a plurality of cDNAs which are differentially expressed in human C3A liver cell cultures treated with steroids or synthetic steroid analogues and which may be used entirely or in part to detect metabolic and toxicological responses to treatment with steroids and steroid antagonists.

BACKGROUND OF THE INVENTION

Array technology can provide a simple way to explore the expression of a single polymorphic gene or the expression profile of a large number of related or unrelated genes. When the expression of a single gene is examined, arrays are employed to detect the expression of a specific gene or its variants. When an expression profile is examined, arrays provide a platform for examining which genes are tissue specific, carrying out housekeeping functions, parts of a signaling cascade, or specifically related to a particular genetic predisposition, condition, disease, or disorder.

The potential application of gene expression profiling is particularly relevant to measuring the toxic response to potential therapeutic compounds and of the metabolic response to therapeutic agents. Diseases treated with steroids and disorders caused by the metabolic response to treatment with steroids include adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease. Response may be measured by comparing both the levels and sequences expressed in tissues from subjects exposed to or treated with steroid compounds such as mifepristone, progesterone, beclomethasone, medroxyprogesterone, budesonide, prednisone, dexamethasone, betamethasone, or danazol with the levels and sequences expressed in normal untreated tissue.

Steroids are a class of lipid-soluble molecules, including cholesterol, bile acids, vitamin D, and hormones, that share a common four-ring structure based on cyclopentanoperhydrophenanthrene and that carry out a wide variety of functions. Cholesterol, for example, is a component of cell membranes that controls membrane fluidity. It is also a precursor for bile acids which solubilize lipids and facilitate absorption in the small intestine during digestion. Vitamin D regulates the absorption of calcium in the small intestine and controls the concentration of calcium in plasma. Steroid hormones, produced by the adrenal cortex, ovaries, and testes, include glucocorticoids, mineralocorticoids, androgens, and estrogens. They control various biological processes by binding to intracellular receptors that regulate transcription of specific genes in the nucleus. Glucocorticoids, for example, increase blood glucose concentrations by regulation of gluconeogenesis in the liver, increase blood concentrations of fatty acids by promoting lipolysis in adipose tissues, modulate sensitivity to catcholamines in the central nervous system, and reduce inflammation. The principal mineralocorticoid, aldosterone, is produced by the adrenal cortex and acts on cells of the distal tubules of the kidney to enhance sodium ion reabsorption. Androgens, produced by the interstitial cells of Leydig in the testis, include the male sex hormone testosterone, which triggers changes at puberty, the production of sperm and maintenance of secondary sexual characteristics. Female sex hormones, estrogen and progesterone, are produced by the ovaries and also by the placenta and adrenal cortex of the fetus during pregnancy. Estrogen regulates female reproductive processes and secondary sexual characteristics. Progesterone regulates changes in the endometrium during the menstrual cycle and pregnancy.

Steroid hormones are widely used for fertility control and in anti-inflammatory treatments for physical injuries and diseases such as arthritis, asthma, and auto-immune disorders. Progesterone, a naturally occurring progestin, is primarily used to treat amenorrhea, abnormal uterine bleeding, or as a contraceptive. Endogenous progesterone is responsible for inducing secretory activity in the endometrium of the estrogen-primed uterus in preparation for the implantation of a fertilized egg and for the maintenance of pregnancy. It is secreted from the corpus luteum in response to luteinizing hormone (LH). The primary contraceptive effect of exogenous progestins involves the suppression of the mid-cycle surge of LH. At the cellular level, progestins diffuse freely into target cells and bind to the progesterone receptor. Target cells include the female reproductive tract, the mammary gland, the hypothalamus, and the pituitary. Once bound to the receptor, progestins slow the frequency of release of gonadotropin releasing hormone from the hypothalamus and blunt the pre-ovulatory LH surge preventing follicular maturation and ovulation. Progesterone has minimal estrogenic and androgenic activity. Progesterone is metabolized hepatically to pregnanediol and conjugated with glucuronic acid.

Medroxyprogesterone (MAH), also known as 6α-methyl-17-hydroxyprogesterone, is a synthetic progestin with a pharmacological activity about 15 times greater than progesterone. MAH is used for the treatment of renal and endometrial carcinomas, amenorrhea, abnormal uterine bleeding, and endometriosis associated with hormonal imbalance. MAH has a stimulatory effect on respiratory centers and has been used in cases of low blood oxygenation caused by sleep apnea, chronic obstructive pulmonary disease, or hypercapnia.

Mifepristone, also known as RU-486, is an antiprogesterone drug that blocks receptors of progesterone. It counteracts the effects of progesterone, which is needed to sustain pregnancy. Mifepristone induces spontaneous abortion when administered in early pregnancy followed by treatment with the prostaglandin, misoprostol. Further, studies show that mifepristone at a substantially lower dose can be highly effective as a postcoital contraceptive when administered within five days after unprotected intercourse. This is the "morning-after pill" used in case of contraceptive failure or sexual assault. Mifepristone also has potential uses in the treatment of breast and ovarian cancers in cases in which tumors are progesterone-dependent. It interferes with steroid-dependent growth of brain meningiomas, and may be useful in treatment of endometriosis by blocking the estrogen-dependent growth of endometrial tissues. It may also be useful in treatment of uterine fibroid tumors and Cushing's syndrome. Mifepristone binds to glucocorticoid receptors and interferes with cortisol binding. Mifepristone also may act as an anti-glucocorticoid and be effective for treating conditions where cortisol levels are elevated such as AIDS, anorexia nervosa, ulcers, diabetes, Parkinson's disease, multiple sclerosis, and Alzheimer's disease.

Danazol is a synthetic steroid derived from ethinyl testosterone. Danazol indirectly reduces estrogen production by lowering pituitary synthesis of follicle-stimulating hormone and LH. Danazol also binds to sex hormone receptors in target tissues, producing anabolic, antiestrogenic, and weakly androgenic activity. Danazol does not possess any progestogenic activity and does not suppress normal pituitary release of corticotropin or release of cortisol by the adrenal glands. Danazol is used in the treatment of endometriosis to relieve pain and inhibit endometrial cell growth. It is also used to treat fibrocystic breast disease and hereditary angioedema.

Corticosteroids are used to relieve inflammation and to suppress the immune response. They inhibit eosinophil, basophil, and airway epithelial cell function by regulation of cytokines that mediate the inflammatory response. They inhibit leukocyte infiltration at the site of inflammation, interfere in the function of mediators of the inflammatory response, and suppress the humoral immune response. Corticosteroids are used to treat allergies, asthma, arthritis, and skin conditions. Beclomethasone is a synthetic glucocorticoid that is used to treat steroid-dependent asthma, to relieve symptoms associated with allergic or nonallergic (vasomotor) rhinitis, or to prevent recurrent nasal polyps following surgical removal. The anti-inflammatory and vasoconstrictive effects of intranasal beclomethasone are 5000 times greater than those produced by hydrocortisone. Budesonide is a corticosteroid used to control symptoms associated with allergic rhinitis or asthma. Budesonide has high topical anti-inflammatory activity but low systemic activity. Dexamethasone is a synthetic glucocorticoid used in anti-inflammatory or immunosuppressive compositions. It is also used in inhalants to prevent symptoms of asthma. Due to its greater ability to reach the central nervous system, dexamethasone is usually the treatment of choice to control cerebral edema. Dexamethasone is approximately 20–30 times more potent than hydrocortisone and 5–7 times more potent than prednisone. Prednisone is metabolized in the liver to its active form, prednisolone, a glucocorticoid with anti-inflammatory properties. Prednisone is approximately 4 times more potent than hydrocortisone and the duration of action of prednisone is intermediate between hydrocortisone and dexamethasone. Prednisone is used to treat allograft rejection, asthma, systemic lupus erythematosus, arthritis, ulcerative colitis, and other inflammatory conditions. Betamethasone is a synthetic glucocorticoid with antiinflammatory and immunosuppressive activity and is used to treat psoriasis and fungal infections such as athlete's foot and ringworm.

The anti-inflammatory actions of corticosteroids are thought to involve phospholipase $A_2$ inhibitory proteins, collectively called lipocortins. Lipocortins, in turn, control the biosynthesis of potent mediators of inflammation such as prostaglandins and leukotrienes by inhibiting the release of the precursor molecule arachidonic acid. Proposed mechanisms of action include decreased IgE synthesis, increased number of β-adrenergic receptors on leukocytes, and decreased arachidonic acid metabolism. During an immediate allergic reaction such as in chronic bronchial asthma, allergens bridge the IgE antibodies on the surface of mast cells and trigger these cells to release chemotactic substances. Mast cell influx and activation is partially responsible for the inflammation and hyperirritability of the oral mucosa in asthmatic patients. This inflammation can be retarded by administration of corticosteroids.

The effects of steroids on liver metabolism and hormone clearance mechanisms are important to understand the pharmacodynamics of a drug. The human C3A cell line is a clonal derivative of HepG2/C3 (hepatoma cell line, isolated from a 15-year-old male with liver tumor), which was selected for strong contact inhibition of growth. The use of a clonal population enhances the reproducibility of the cells. C3A cells have many characteristics of primary human hepatocytes in culture including i) expression of insulin receptor and insulin-like growth factor II receptor; ii) secretion of a high ratio of serum albumin compared with α-fetoprotein iii) conversion of ammonia to urea and glutamine; iv) metabolism of aromatic amino acids; and v) proliferation in glucose-free and insulin-free medium. The C3A cell line is well established as an in vitro model of the mature human liver (Mickelson et al. (1995) Hepatology 22:866–875; Nagendra et al. (1997) Am J Physiol 272:G408–G416).

The present invention provides a combination comprising a plurality of cDNAs for use in detecting changes in expression of genes encoding proteins that are associated with steroid treatment. Such a combination satisfies a need in the art by providing a set of differentially expressed genes which may be used entirely or in part to detect metabolic and toxicological responses to steroid compounds and therapeutics.

SUMMARY

The present invention provides a combination comprising a plurality of cDNAs and their complements which are differentially expressed in human C3A cells treated with steroid compounds and which are selected from SEQ ID NOs:1, 2, 3, 5, 6, 8, 9, 11–14, 16–18, 20, 21, 23–34, 36, 38–40, 42–50, 52–63, 65, 66, 68–71, 73–75, 77–84, 86–111, 113–115, 117–126, 128–142, 145–160, 162–164, 166, 167, 169–172, 174–176, 178–186, 188–197, 199–202, 204–211, 213, 215, 217–228, 230–246, 248–251, 253–259, 261–266, 268–277, 279, 281, 283, 284, 286, 288–292, 294, 295, 297–300, 302–308, 310, 311, 313, 315–320, 322, 323, 325, 327–346, 348–350, 352–357, 359–368, 370–372, 374, 376, 378, 380–389, 391–400, 402, 403, 405–413, 415, 416, 418, 420, 422–426, 428, 429, 431–446, 448, 450–453, 455, 457, 459, 461, 463–466, 468–470, 472–478, 480–488, 490–492, 494–502, 504–506, 508–520, 522–526, 528–530, 532, 534, 535, 537–561, 563–565, 567, 569–575, 577, 579–581, 583, 585–589, 591–614, 616, 618, 619, 621, 623, 625, 627, 629–641, 643, 645–654, 656–663, 665–680, 682–698, 700–708, 710, 712–720, 722–725, 727–730, 732, 734, 735, 737–741, 743–754, 756, 758–768, 770–780, 782–786, 788–792, 794, 796–802, 804–806, 808, 809, 811–814, 816, 817, 819–829, 831, 833, 835, 836, 838–840, 842–888, 890–892, 894–908, 910, 912, 914–927, 929, 930, 932–937, 939–944, 946, 948–957, 959–964, 966–976, 978–988, 990–999, 1001–1008, 1010–1028, 1030–1034, 1036–1085, 1087–1096, 1098–1143 as presented in the Sequence Listing. The level of each cDNA is downregulated or upregulated at least 2.5-fold. In one aspect, the combination is useful to diagnose a liver disorder selected from adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease and for detecting metabolic and toxicological responses to treatment with steroids. In another aspect, the combination is immobilized on a substrate.

The invention also provides a high throughput method to detect differential expression of one or more of the cDNAs of the combination. The method comprises hybridizing the substrate comprising the combination with the nucleic acids of a sample, thereby forming one or more hybridization complexes, detecting the hybridization complexes, and comparing the hybridization complexes with those of a standard, wherein differences in the size and signal intensity of each hybridization complex indicates differential expression of nucleic acids in the sample. In one aspect, the sample is from a subject with a liver disorder associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease and differential expression determines an early, mid, and late stage of that disorder.

The invention further provides a high throughput method of screening a library or a plurality of molecules or compounds to identify a ligand. The method comprises combining the substrate comprising the combination with a library or plurality of molecules or compounds under conditions to allow specific binding and detecting specific binding, thereby identifying a ligand. The library or plurality of molecules or compounds are selected from DNA molecules, RNA molecules, peptide nucleic acid molecules, mimetics, peptides, transcription factors, repressors, and other regulatory proteins. The invention additionally provides a method for purifying a ligand, the method comprising combining a cDNA of the invention with a sample under conditions which allow specific binding, recovering the bound cDNA, and separating the cDNA from the ligand, thereby obtaining purified ligand.

The invention still further provides an isolated cDNA selected from SEQ ID NOs:2, 17, 23, 24, 31, 32, 54, 57, 58, 60, 69, 73, 81–83, 86, 88, 90, 94–98, 102–105, 108, 113, 120–124, 129, 130, 133–135, 137, 140, 142, 145, 146, 148, 152, 154, 156, 157, 166, 174, 182, 185, 188, 189, 192, 194, 199, 205, 206, 208, 221, 234, 235–239, 253, 256, 258, 261, 271, 290, 297, 304, 307, 331, 338, 342, 343, 352, 354, 355, 360, 362, 364, 365, 380, 381, 395, 396, 402, 410, 412, 424, 428, 432, 435, 436, 438, 440, 444, 450, 464, 465, 472, 476, 477, 480, 487–490, 499–501, 510–512, 515, 519, 524, 528, 529, 538–542, 544, 545, 547, 549, 550, 554, 556, 558, 559, 563, 564, 570–572, 574, 580, 585, 588, 591, 594, 599–607, 648, 649, 651–653, 657, 658, 669, 670, 675, 677, 678, 684, 685, 688, 692–696, 700–705, 716, 728, 729, 739, 743, 748, 749, 751, 761, 763, 766, 767, 772, 783, 785, 790, 797, 798, 800, 805, 812, 813, 821, 825, 828, 839, 843, 846, 851–854, 857–859, 863–867, 873, 875, 879, 881–884, 887, 896, 901, 902, 905, 914, 916, 919, 923, 929, 933, 935, 936, 942, 948, 949–956, 959, 962, 963, 966, 969, 970, 972, 980, 984, 990–993, 998, 1003, 1004, 1007, 1013, 1016, 1020, 1026, 1027, 1030, 1037, 1038, 1040, 1042, 1046, 1051, 1056, 1059, 1063, 1068–1070, 1075, 1078, 1081, 1087, 1088, 1090, 1092–1095, 1099, 1105, 1107, 1108, 1113, 1117, 1118, 1121, 1128, 1129, 1132, 1140, 1141, and 1143 as presented in the Sequence Listing. The invention also provides a vector comprising the cDNA, a host cell comprising the vector, and a method for producing a protein comprising culturing the host cell under conditions for the expression of a protein and recovering the protein from the host cell culture.

The present invention provides a purified protein encoded and produced by a cDNA of the invention. The invention also provides a high-throughput method for using a protein to screen a library or a plurality of molecules or compounds to identify a ligand. The method comprises combining the protein or a portion thereof with the library or plurality of molecules or compounds under conditions to allow specific binding and detecting specific binding, thereby identifying a ligand which specifically binds the protein. The library or plurality of molecules or compounds is selected from aptamers, DNA molecules, RNA molecules, peptide nucleic acid molecules, mimetics, peptides, proteins, agonists, antagonists, antibodies or their fragments, immunoglobulins, inhibitors, drug compounds, and pharmaceutical agents. The invention further provides for using a protein to purify a ligand. The method comprises combining the protein or a portion thereof with a sample under conditions to allow specific binding, recovering the bound protein, and separating the protein from the ligand, thereby obtaining purified ligand. The invention still further provides a composition comprising the protein and a pharmaceutical carrier.

The invention also provides methods for using a protein to prepare and purify polyclonal and monoclonal antibodies which specifically bind the protein. The method for preparing a polyclonal antibody comprises immunizing a animal with protein under conditions to elicit an antibody response, isolating animal antibodies, attaching the protein to a substrate, contacting the substrate with isolated antibodies under conditions to allow specific binding to the protein dissociating the antibodies from the protein, thereby obtaining purified polyclonal antibodies. The method for preparing and purifying monoclonal antibodies comprises immunizing a animal with a protein under conditions to elicit an antibody response, isolating antibody producing cells from the animal, fusing the antibody producing cells with immortalized cells in culture to form monoclonal antibody producing hybridoma cells, culturing the hybridoma cells, and isolating from culture monoclonal antibodies which specifically bind the protein.

The invention provides a purified antibody that specifically binds a protein expressed in a liver disorder. The invention also provides a method for using an antibody to detect expression of a protein in a sample comprising combining the antibody with a sample under conditions which allow the formation of antibody:protein complexes and detecting complex formation, wherein complex formation indicates expression of the protein in the sample.

DESCRIPTION OF THE SEQUENCE LISTING AND TABLES

A portion of the disclosure of this patent document contains material that is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

The Sequence Listing is a compilation of cDNAs obtained by sequencing and extending clone inserts. Each sequence is identified by a sequence identification number (SEQ ID NO)

and by the Incyte identification number (Incyte ID) from which it was obtained.

Table 1 lists the functional annotation of the cDNAs of the present invention. Columns 1 and 2 show the SEQ ID NO and TEMPLATE ID, respectively. Columns 3, 4, and 5 show the GenBank ID, probability score (E-value), and functional annotation, respectively, as determined by BLAST analysis (version 1.4 using default parameters; Altschul (1993) J Mol Evol 36: 290–300; Altschul et al. (1990) J Mol Biol 215:403–410) of the cDNA against GenBank (release 117; National Center for Biotechnology Information (NCBI), Bethesda Md.).

Table 2 shows Pfam annotations of the cDNAs of the present invention. Columns 1 and 2 show the SEQ ID NO and Clone ID, respectively. Columns 3, 4, and 5 show the first residue (START), last residue (STOP), and reading frame, respectively, for the segment of the cDNA identified by Pfam analysis. Columns 6 and 7 show the Pfam description and E-values, respectively, corresponding to the polypeptide domain encoded by the cDNA segment.

Table 3 shows the region of each cDNA encompassed by the clone present on a microarray and identified as differentially expressed. Columns 1 and 2 show the SEQ ID NO and TEMPLATE ID, respectively. Column 3 shows the CLONE ID and columns 4 and 5 show the first residue (START) and last residue (STOP) encompassed by the clone on the template sequence.

Table 4 shows signal peptide and transmembrane regions predicted within the cDNAs of the present invention. Columns 1 and 2 show the SEQ ID NO and TEMPLATE ID, respectively. Columns 3, 4, and 5 show the first residue (START), last residue (STOP), and reading frame (FRAME), respectively, for a segment of the cDNA, and column 6 (HIT TYPE) identifies the polypeptide encoded by the segment as either a signal peptide (SP) or transmembrane (TM) domain.

Table 5 lists the tissue distribution of the nucleotide templates. Columns 1 and 2 list the SEQ ID NO and TEMPLATE ID, respectively. Column 3 lists the predominant tissue distribution (TISSUE DISTRIBUTION) as a percentage of total tissues in the LIFESEQ GOLD database (Incyte Genomics, Palo Alto Calif.).

Tables 6–14 show the differentially expressed genes associated with treatment of human C3A cells with various steroid compounds. Differentially expressed genes associated with mifepristone (mife) treatment are shown in Table 6; with progesterone (Prog) treatment in Table 7; with beclomethasone (Beclo) treatment in Table 8; with medroxyprogesterone (MAH) treatment in Table 9; with budesonide (bude) treatment in Table 10; with prednisone (Prdsne) treatment in Table 11; with dexamethasone (Dex) treatment in Table 12; with betamethasone (Betam) treatment in Table 13; and with danazol treatment in Table 14. In each table, genes are grouped by similarity in response to the compound as determined by K-means clustering algorithms; cluster numbers are associated with specific GEM designs.

In Tables 6–14, column 1 shows the Incyte clone ID number; column 2 shows the average log2 differential expression value for treated C3A cells, column 3 shows the range of log2 mean differential expression values for treated C3A cells, columns 4 through 12 show the log2 mean differential expression values for C3A cells treated with the steroid compound at concentrations of 1, 10, and 100 $\mu$M for 1, 3, and 6 hours; column 13 shows the cluster number to which the gene was assigned, and column 14 shows the GEM microarray (Incyte Genomics) designation for the gene.

Table 15 lists the genes that showed differential expression with all of the steroid compounds. Column 1 shows the Incyte clone ID number, columns 2 and 3 show the GenBank ID and functional annotation respectively, column 4 shows the average log2 differential expression value for treated C3A cells, and column 5 shows the steroid used in treatment of human C3A liver cells.

Table 16 lists the genes that showed differential expression selectively with only one of the steroid compounds. Column 1 shows the Incyte clone ID number, column 2 shows the average log2 differential expression value for treated C3A cells, and column 3 shows the steroid used in treatment of human C3A liver cells.

Tables 17–25 show groups of genes that are regulated selectively by two or three of the steroids. Table 17 shows groups of genes that are differentially expressed selectively in response to progesterone and either MAH or betamethasone. Table 18 shows groups of genes that are differentially expressed selectively in response to mifepristone and either MAH or danazol. Table 19 shows groups of genes that are differentially expressed selectively in response to MAH and each of the other steroids. Table 20 shows groups of genes that are differentially expressed selectively in response to danazol and mifepristone, MAH or betamethasone. Table 21 shows groups of genes that are differentially expressed selectively in response to dexamethasone and either other corticosteroids or MAH. Table 22 shows groups of genes that are differentially expressed selectively in response to betamethasone and either other corticosteroids, or MAH, progesterone, or danazol. Table 23 shows groups of genes that are differentially expressed selectively in response to beclomethasone and either other corticosteroids or MAH. Table 24 shows groups of genes that are differentially expressed selectively in response to budesonide and either other corticosteroids or MAH. Table 25 shows groups of genes that are differentially expressed selectively in response to prednisone and either other corticosteroids or MAH.

In Tables 17–25, column 1 shows the Incyte clone ID number, column 2 shows the average log2 differential expression value for treated C3A cells, and column 3 shows the steroid used in treatment of human C3A liver cells.

DESCRIPTION OF THE INVENTION

Definitions

"Array" refers to an ordered arrangement of at least two cDNAs on a substrate. At least one of the cDNAs represents a control or standard sequence, and the other, a cDNA of diagnostic interest. The arrangement of from about two to about 40,000 cDNAs on the substrate assures that the size and signal intensity of each labeled hybridization complex formed between a cDNA and a sample nucleic acid is individually distinguishable.

The "complement" of a nucleic acid molecule of the Sequence Listing refers to a nucleotide sequence which is completely complementary over the full length of the sequence and which will hybridize to the nucleic acid molecule under conditions of high stringency.

A "combination" comprises at least two and up to 1143 sequences selected from the group consisting of SEQ ID NOs:1–1143 as presented in the Sequence Listing.

"cDNA" refers to a chain of nucleotides, an isolated polynucleotide, nucleic acid molecule, or any fragment or complement thereof. It may have originated recombinantly or synthetically, be double-stranded or single-stranded, coding and/or noncoding, an exon with or without an intron from a genomic DNA molecule, and purified or combined with carbohydrate, lipids, protein or inorganic elements or substances. Preferably, the cDNA is from about 400 to about 10000 nucleotides.

The phrase "cDNA encoding a protein" refers to a nucleic acid sequence that closely aligns with sequences which encode conserved regions, motifs or domains that were identified by employing analyses well known in the art. These analyses include BLAST (Basic Local Alignment Search Tool; Altschul (1993) J Mol Evol 36: 290–300; Altschul et al. (1990) J Mol Biol 215–410) which provides identity within the conserved region. Brenner et al. (1998; Proc Natl Acad Sci 95:6073–6078) who analyzed BLAST for its ability to identify structural homologs by sequence identity found 30% identity is a reliable threshold for sequence alignments of at least 150 residues and 40% is a reasonable threshold for alignments of at least 70 residues (Brenner et al., page 6076, column 2).

"Derivative" refers to a cDNA or a protein that has been subjected to a chemical modification. Derivatization of a cDNA can involve substitution of a nontraditional base such as queosine or of an analog such as hypoxanthine. These substitutions are well known in the art. Derivatization of a protein involves the replacement of a hydrogen by an acetyl, acyl, alkyl, amino, formyl, or morpholino group. Derivative molecules retain the biological activities of the naturally occurring molecules but may confer advantages such as longer lifespan or enhanced activity.

"Differential expression" refers to an increased or upregulated or a decreased or downregulated expression as detected by absence, presence, or at least 2.5-fold change in the amount of transcribed messenger RNA or translated protein in a sample.

"Disorder" refers to conditions, diseases or syndromes such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, Wilson disease, and toxicological responses associated with the use of steroid compounds.

"Fragment" refers to a chain of consecutive nucleotides from about 200 to about 700 base pairs in length. Fragments may be used in PCR or hybridization technologies to identify related nucleic acid molecules and in binding assays to screen for a ligand. Nucleic acids and their ligands identified in this manner are useful as therapeutics to regulate replication, transcription or translation.

A "hybridization complex" is formed between a cDNA and a nucleic acid of a sample when the purines of one molecule hydrogen bond with the pyrimidines of the complementary molecule, e.g., 5'-A-G-T-C-3' base pairs with 3'-T-C-A-G-5'. The degree of complementarity and the use of nucleotide analogs affect the efficiency and stringency of hybridization reactions.

"Identity" as applied to sequences, refers to the quantification (usually percentage) of nucleotide or residue matches between at least two sequences aligned using a standardized algorithm such as Smith-Waterman alignment (Smith and Waterman (1981) J Mol Biol 147:195–197), CLUSTALW (Thompson et al. (1994) Nucleic Acids Res 22:4673–4680), or BLAST2 (Altschul et al. (1997) supra). BLAST2 may be used in a standardized and reproducible way to insert gaps in one of the sequences in order to optimize alignment and to achieve a more meaningful comparison between them. "Similarity" as applied to proteins uses the same algorithms but takes into account conservative substitutions of nucleotides or residues.

"Ligand" refers to any agent, molecule, or compound which will bind specifically to a complementary site on a cDNA molecule or polynucleotide, or to an epitope or a protein. Such ligands stabilize or modulate the activity of polynucleotides or proteins and may be composed of inorganic or organic substances including nucleic acids, proteins, carbohydrates, fats, and lipids.

"Oligonucleotide" refers a single stranded molecule from about 18 to about 60 nucleotides in length which may be used in hybridization or amplification technologies or in regulation of replication, transcription or translation. Substantially equivalent terms are amplimer, primer, and oligomer.

"Portion" refers to any part of a protein used for any purpose which retains at least one biological or antigenic characteristic of a native protein; but especially, to an epitope for the screening of ligands or for the production of antibodies.

"Post-translational modification" of a protein can involve lipidation, glycosylation, phosphorylation, acetylation, racemization, proteolytic cleavage, and the like. These processes may occur synthetically or biochemically. Biochemical modifications will vary by cellular location, cell type, pH, enzymatic milieu, and the like.

"Probe" refers to a cDNA that hybridizes to at least one nucleic acid molecule in a sample. Where targets are single stranded, probes are complementary single strands. Probes can be labeled with reporter molecules for use in hybridization reactions including Southern, northern, in situ, dot blot, array, and like technologies or in screening assays.

"Protein" refers to a polypeptide or any portion thereof. An "oligopeptide" is an amino acid sequence from about five residues to about 15 residues that is used as part of a fusion protein to produce an antibody.

"Purified" refers to any molecule or compound that is separated from its natural environment and is preferably about 60% free and more preferably about 90% free from other components with which it is naturally associated.

"Sample" is used in its broadest sense as containing nucleic acids, proteins, antibodies, and the like. A sample may comprise a bodily fluid; the soluble fraction of a cell preparation, or an aliquot of media in which cells were grown; a chromosome, an organelle, or membrane isolated or extracted from a cell; genomic DNA, RNA, or cDNA in solution or bound to a substrate; a cell; a tissue or a tissue biopsy; a tissue print; a fingerprint, buccal cells, skin, or hair; and the like.

"Specific binding" refers to a special and precise interaction between two molecules which is dependent upon their structure, particularly their molecular side groups. For example, the intercalation of a regulatory protein into the major groove of a DNA molecule, the hydrogen bonding along the backbone between two single stranded nucleic acids, or the binding between an epitope of a protein and an agonist, antagonist, or antibody.

"Substrate" refers to any rigid or semi-rigid support to which cDNAs or proteins are bound and includes membranes, filters, chips, slides, wafers, fibers, magnetic or nonmagnetic beads, gels, capillaries or other tubing, plates, polymers, and microparticles with a variety of surface forms including wells, trenches, pins, channels and pores.

"Variant" refers to molecules that are recognized variations of a cDNA or a protein encoded by the cDNA. Splice variants may be determined by BLAST score, wherein the score is at least 100, and most preferably at least 400. Allelic variants have a high percent identity to the cDNAs and may differ by about three bases per hundred bases. "Single nucleotide polymorphism" (SNP) refers to a change in a single base as a result of a substitution, insertion or deletion.

The change may be conservative (purine for purine) or non-conservative (purine to pyrimidine) and may or may not result in a change in an encoded amino acid.

The Invention

The present invention provides for a combination comprising a plurality of cDNAs or their complements, SEQ ID NOs:1, 2, 3, 5, 6, 8, 9, 11–14, 16–18, 20, 21, 23–34, 36, 38–40, 42–50, 52–63, 65, 66, 68–71, 73–75, 77–84, 86–111, 113–115, 117–126, 128–142, 145–160, 162–164, 166, 167, 169–172, 174–176, 178–186, 188–197, 199–202, 204–211, 213, 215, 217–228, 230–246, 248–251, 253–259, 261–266, 268–277, 279, 281, 283, 284, 286, 288–292, 294, 295, 297–300, 302–308, 310, 311, 313, 315–320, 322, 323, 325, 327–346, 348–350, 352–357, 359–368, 370–372, 374, 376, 378, 380–389, 391–400, 402, 403, 405–413, 415, 416, 418, 420, 422–426, 428, 429, 431–446, 448, 450–453, 455, 457, 459, 461, 463–466, 468–470, 472–478, 480–488, 490–492, 494–502, 504–506, 508–520, 522–526, 528–530, 532, 534, 535, 537–561, 563–565, 567, 569–575, 577, 579–581, 583, 585–589, 591–614, 616, 618, 619, 621, 623, 625, 627, 629–641, 643, 645–654, 656–663, 665–680, 682–698, 700–708, 710, 712–720, 722–725, 727–730, 732, 734, 735, 737–741, 743–754, 756, 758–768, 770–780, 782–786, 788–792, 794, 796–802, 804–806, 808, 809, 811–814, 816, 817, 819–829, 831, 833, 835, 836, 838–840, 842–888, 890–892, 894–908, 910, 912, 914–927, 929, 930, 932–937, 939–944, 946, 948–957, 959–964, 966–976, 978–988, 990–999, 1001–1008, 1010–1028, 1030–1034, 1036–1085, 1087–1096, 1098–1143 which may be used on a substrate to detect metabolic and toxicological responses to treatment with steroids and steroid antagonists and as diagnostics for liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease. These cDNAs represent known and novel genes differentially expressed in human C3A liver cells treated with mifepristone, progesterone, beclomethasone, medroxyprogesterone, budesonide, prednisone, dexamethasone, betamethasone, or danazol. The combination may be used in its entirety or in part, as subsets of downregulated cDNAs or of upregulated cDNAs. SEQ ID NOs:2, 17, 23, 24, 31, 32, 54, 57, 58, 60, 69, 73, 81–83, 86, 88, 90, 94–98, 102–105, 108, 113, 120, 121, 123, 124, 129, 130, 133–135, 137, 140, 142, 145, 146, 148, 152, 154, 156, 157, 166, 174, 182, 185, 188, 189, 192, 194, 199, 205, 206, 208, 221, 234–239, 253, 256, 258, 261, 271, 290, 297, 304, 307, 331, 338, 342, 343, 352, 354, 355, 360, 362, 364, 365, 380, 381, 395, 396, 402, 410, 412, 424, 428, 432, 435, 436, 438, 440, 444, 450, 464, 465, 472, 476, 477, 480, 487–490, 499, 500, 501, 510–512, 515, 519, 524, 528, 529, 538–542, 544, 545, 547, 549, 550, 554, 556, 558, 559, 563, 564, 570–572, 574, 580, 585, 588, 591, 594, 599, 600–607, 648, 649, 651–653, 657, 658, 669, 670, 675, 677, 678, 684, 685, 688, 692–696, 700–705, 716, 728, 729, 739, 743, 748, 749, 751, 761, 763, 766, 767, 772, 783, 785, 790, 797, 798, 800, 805, 812, 813, 821, 825, 828, 839, 843, 846, 851–854, 857–859, 863–867, 873, 875, 879, 881–884, 887, 896, 901, 902, 905, 914, 916, 919, 923, 929, 933, 935, 936, 942, 948, 949, 952–956, 959, 962, 963, 966, 969, 970, 972, 980, 984, 990–993, 998, 1003, 1004, 1007, 1013, 1016, 1020, 1026, 1027, 1030, 1037, 1038, 1040, 1042, 1046, 1051, 1056, 1059, 1063, 1068–1070, 1075, 1078, 1081, 1087, 1088, 1090, 1092–1095, 1099, 1105, 1107, 1108, 1113, 1117, 1118, 1121, 1128, 1129, 1132, 1140, 1141, and 1143 represent novel cDNAs associated with the response of C3A cells to treatment with steroids. Since the novel cDNAs were identified solely by their differential expression, it is not essential to know a priori the name, structure, or function of the gene or the encoded protein. The usefulness of the novel cDNAs exists in their immediate value as diagnostics for liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease, and for detection of metabolic and toxicological responses to treatment with steroids and steroid antagonists.

The invention also provides isolated proteins, SEQ ID NOs:4, 7, 10, 15, 19, 22, 35, 37, 41, 51, 64, 67, 72, 76, 85, 112, 116, 127, 143, 144, 161, 165, 168, 173, 177, 187, 198, 203, 212, 214, 216, 229, 247, 252, 260, 267, 278, 280, 282, 285, 287, 293, 296, 301, 309, 312, 314, 321, 324, 326, 347, 351, 358, 369, 373, 375, 377, 379, 390, 401, 404, 414, 417, 419, 421, 427, 430, 443, 447, 449, 454, 456, 458, 460, 462, 467, 471, 479, 489, 493, 503, 507, 521, 527, 531, 533, 536, 562, 566, 568, 576, 578, 582, 584, 590, 615, 617, 620, 622, 624, 626, 628, 642, 644, 655, 664, 681, 699, 709, 711, 721, 726, 731, 733, 736, 742, 755, 757, 769, 781, 787, 793, 795, 803, 807, 810, 815, 818, 830, 832, 834, 837, 841, 889, 893, 909, 911, 913, 928, 931, 938, 945, 947, 958, 965, 977, 989, 1000, 1009, 1029, 1035, 1086, and 1097 which are encoded by the cDNAs of SEQ ID NOs:3, 6, 9, 14, 18, 21, 34, 36, 40, 50, 63, 66, 71, 75, 84, 111, 115, 126, 143, 160, 164, 167, 172, 176, 186, 197, 202, 211, 213, 215, 228, 246, 251, 259, 266, 277, 279, 281, 284, 286, 292, 295, 300, 308, 311, 313, 320, 323, 325, 346, 350, 357, 368, 372, 374, 376, 378, 389, 400, 403, 413, 416, 418, 420, 426, 429, 442, 446, 448, 453, 455, 457, 459, 461, 466, 470, 478, 488, 492, 502, 506, 520, 526, 530, 532, 535, 561, 565, 567, 575, 577, 581, 583, 589, 614, 616, 619, 621, 623, 625, 627, 641, 643, 654, 663, 680, 698, 708, 710, 720, 725, 730, 732, 735, 741, 754, 756, 768, 780, 786, 792, 794, 802, 806, 809, 814, 817, 829, 831, 833, 836, 840, 888, 892, 908, 910, 912, 927, 930, 937, 944, 946, 957, 964, 976, 988, 999, 1008, 1028, 1034, 1085, and 1096 respectively as shown in Table 1.

Agglomerative cluster analysis was used to identify response patterns and to establish relationships between different gene expression profiles. Each gene measurement was normalized by dividing the expression ratios by the maximum value for each time series. The clustering process defined a hierarchical tree with the number of branches intersecting at each branch level of the tree equal to the number of clusters at that level.

Table 1 shows those genes on the array having differential expression (2.5-fold or greater increase or decrease) in treated human C3A liver cell cultures, the encoded protein sequences which correspond to the upregulated or downregulated clones present on the array, and the functional annotation of the template cDNAs as determined by BLAST analysis. Table 2 shows the functional annotation as determined by Pfam analysis. Table 3 shows the positional information of the clone present on the array relative to the nucleotide template sequence. Table 4 shows the functional annotation as determined by Hidden Markov Model analysis for signal peptide (SP) or for transmembrane (TM) regions. Table 5 shows the tissue distribution of the nucleotide template sequences. Tables 6–14 show those genes on the array having differential expression (2.5-fold or greater increase or decrease) in human C3A cells treated with mifepristone, progesterone, beclomethasone, medroxyprogesterone, budesonide, prednisone, dexamethasone, betamethasone, or danazol respectively. Table 15 lists the genes, identified by Incyte Clone ID, that showed differential expression with all of the steroid compounds. Genes represented by Incyte clones 279898 and 4287327 on the microarray are upregulated by all of the steroid compounds. Genes represented by Incyte clones 560115, 1619292, 2769888, 3120209, 3135460, 4408943, 5047895, 5166479, and 5427710 on the microarray are downregulated by all of the steroid compounds. Table 16 lists the genes that showed differential expression selectively with only one of the steroid compounds. Table 17 shows the group of genes that are differentially expressed selectively in response to progesterone and are regulated similarly by either the synthetic progestin MAH or the glucocorticoid betamethasone. Table 18 shows the group of genes that are differentially expressed selectively in response to mifepristone and are regulated similarly by other steroids which bind to sex hormone receptors including MAH or danazol. Table 19 shows the group of genes that are differentially expressed selectively in response to MAH. The synthetic progestin MAH alters the expression of a wider range of genes than progesterone. Table 20 shows the group of genes that are differentially expressed selectively in response to danazol and mifepristone, MAH or betamethasone. Danazol, mifepristone, and MAH show similar effects on differential expression. Danazol and betamethasone show opposing effects on expression. Table 21 shows the group of genes that are differentially expressed selectively in response to dexamethasone and are regulated similarly by either other corticosteroids or MAH. Beclomethasone, compared with the other corticosteroids, regulates the most genes in common with dexamethasone and shows the most similarity in its effects on gene expression. Table 22 shows the group of genes that are differentially expressed selectively in response to betamethasone and are regulated similarly by other corticosteroids, MAH, progesterone, or danazol. Budesonide, compared with the other corticosteroids, regulates the most genes in common with betamethasone and shows the most similarity in its effects on gene expression. Betamethasone in contrast to the other corticosteroids, regulates a significant number of genes in common with progesterone and other steroids which bind sex hormone receptors. Table 23 shows the group of genes that are differentially expressed selectively in response to beclomethasone and are regulated similarly by either other corticosteroids or MAH. Table 24 shows that group of genes that are differentially expressed selectively in response to budesonide and are regulated similarly by either other corticosteroids or MAH. Betamethasone, compared with the other corticosteroids, regulates the most genes in common with budesonide. Table 25 shows the group of genes that are differentially expressed selectively in response to prednisone and are regulated similarly by either other corticosteroids or MAH.

The cDNAs of the invention define a differential expression pattern against which to compare the expression pattern of biopsied and/or in vitro treated human liver tissues. Experimentally, differential expression of the cDNAs can be evaluated by methods including, but not limited to, differential display by spatial immobilization or by gel electrophoresis, genome mismatch scanning, representational discriminant analysis, clustering, transcript imaging and array technologies. These methods may be used alone or in combination.

The combination may be arranged on a substrate and hybridized with tissues from subjects with diagnosed liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease to identify those sequences which are differentially expressed and for detection of metabolic and toxicological responses to treatment with steroids and steroid antagonists. This allows identification of those sequences of highest diagnostic and potential therapeutic value. In one embodiment, an additional set of cDNAs, such as cDNAs encoding signaling molecules, are arranged on the substrate with the combination. Such combinations may be useful in the elucidation of pathways which are affected in particular liver disorders associated with steroid therapy or to identify new, coexpressed, candidate, toxicological markers.

In another embodiment, the combination can be used for large scale genetic or gene expression analysis of a large number of novel, nucleic acid molecules. These samples are prepared by methods well known in the art and are from mammalian cells or tissues which are in a certain stage of development; have been treated with a known molecule or compound, such as a cytokine, growth factor, a drug, and the like; or have been extracted or biopsied from a mammal with a known or unknown condition, disorder, or disease before or after treatment. The sample nucleic acid molecules are hybridized to the combination for the purpose of defining a novel gene profile associated with that developmental stage, treatment, or disorder.

cDNAs and Their Uses cDNAs can be prepared by a variety of synthetic or enzymatic methods well known in the art. cDNAs can be synthesized, in whole or in part, using chemical methods well known in the art (Caruthers et al. (1980) Nucleic Acids Symp Ser (7)215–233). Alternatively, cDNAs can be produced enzymatically or recombinantly, by in vitro or in vivo transcription.

Nucleotide analogs can be incorporated into cDNAs by methods well known in the art. The only requirement is that the incorporated analog must base pair with native purines or pyrimidines. For example, 2,6-diaminopurine can substitute for adenine and form stronger bonds with thymidine than those between adenine and thymidine. A weaker pair is formed when hypoxanthine is substituted for guanine and base pairs with cytosine. Additionally, cDNAs can include nucleotides that have been derivatized chemically or enzymatically.

cDNAs can be synthesized on a substrate. Synthesis on the surface of a substrate may be accomplished using a chemical coupling procedure and a piezoelectric printing apparatus as described by Baldeschweiler et at. (PCT publication WO95/251116). Alternatively, the cDNAs can be synthesized on a substrate surface using a self-addressable electronic device that controls when reagents are added as described by Heller et al. (U.S. Pat. No. 5,605,662). cDNAs can be synthesized directly on a substrate by sequentially dispensing reagents for their synthesis on the substrate surface or by dispensing preformed DNA fragments to the substrate surface. Typical dispensers include a micropipette delivering solution to the substrate with a robotic system to control the position of the micropipette with respect to the substrate. There can be a multiplicity of dispensers so that reagents can be delivered to the reaction regions efficiently.

cDNAs can be immobilized on a substrate by covalent means such as by chemical bonding procedures or UV irradiation. In one method, a cDNA is bound to a glass surface which has been modified to contain epoxide or aldehyde groups. In another method, a cDNA is placed on a polylysine coated surface and UV cross-linked to it as described by Shalon et al. (WO95/35505). In yet another method, a cDNA is actively transported from a solution to a given position on a substrate by electrical means (Heller, supra). cDNAs do not have to be directly bound to the substrate, but rather can be bound to the substrate through a linker group. The linker groups are typically about 6 to 50 atoms long to provide exposure of the attached cDNA. Preferred linker groups include ethylene glycol oligomers, diamines, diacids and the like. Reactive groups on the substrate surface react with a terminal group of the linker to bind the linker to the substrate. The other terminus of the linker is then bound to the cDNA. Alternatively, polynucleotides, plasmids or cells can be arranged on a filter. In the latter case, cells are lysed, proteins and cellular components degraded, and the DNA is coupled to the filter by UV cross-linking.

The cDNAs may be used for a variety of purposes. For example, the combination of the invention may be used on an array. The array, in turn, can be used in high-throughput methods for detecting a related polynucleotide in a sample, screening a plurality of molecules or compounds to identify a ligand, diagnosing liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease, detecting metabolic and toxicological responses to treatment with steroids and steroid antagonists, or inhibiting or inactivating a therapeutically relevant gene related to the cDNA.

When the cDNAs of the invention are employed on a microarray, the cDNAs are arranged in an ordered fashion so that each cDNA is present at a specified location. Because the cDNAs are at specified locations on the substrate, the hybridization patterns and intensities, which together create a unique expression profile, can be interpreted in terms of expression levels of particular genes and can be correlated with a particular metabolic process, condition, disorder, disease, stage of disease, or treatment.

Hybridization

The cDNAs or fragments or complements thereof may be used in various hybridization technologies. The cDNAs may be labeled using a variety of reporter molecules by either PCR, recombinant, or enzymatic techniques. For example, a commercially available vector containing the cDNA is transcribed in the presence of an appropriate polymerase, such as T7 or SP6 polymerase, and at least one labeled nucleotide. Commercial kits are available for labeling and cleanup of such cDNAs. Radioactive (Amersham Pharmacia Biotech (APB), Piscataway N.J.), fluorescent (Operon Technologies, Alameda Calif.), and chemiluminescent labeling (Promega, Madison Wis.) are well known in the art.

A cDNA may represent the complete coding region of an mRNA or be designed or derived from unique regions of the mRNA or genomic molecule, an intron, a 3' untranslated region, or from a conserved motif. The cDNA is at least 18 contiguous nucleotides in length and is usually single stranded. Such a cDNA may be used under hybridization conditions that allow binding only to an identical sequence, a naturally occurring molecule encoding the same protein, or an allelic variant. Discovery of related human and mammalian sequences may also be accomplished using a pool of degenerate cDNAs and appropriate hybridization conditions. Generally, a cDNA for use in Southern or northern hybridizations may be from about 400 to about 6000 nucleotides long. Such cDNAs have high binding specificity in solution-based or substrate-based hybridizations. An oligonucleotide, a fragment of the cDNA, may be used to detect a polynucleotide in a sample using PCR.

The stringency of hybridization is determined by G+C content of the cDNA, salt concentration, and temperature. In particular, stringency is increased by reducing the concentration of salt or raising the hybridization temperature. In solutions used for some membrane based hybridizations, addition of an organic solvent such as formamide allows the reaction to occur at a lower temperature. Hybridization may be performed with buffers, such as 5×saline sodium citrate (SSC) with 1% sodium dodecyl sulfate (SDS) at 60° C., that permit the formation of a hybridization complex between nucleic acid sequences that contain some mismatches. Subsequent washes are performed with buffers such as 0.2×SSC with 0.1% SDS at either 45° C. (medium stringency) or 65°–68° C. (high stringency). At high stringency, hybridization complexes will remain stable only where the nucleic acid molecules are completely complementary. In some membrane-based hybridizations, preferably 35% or most preferably 50%, formamide may be added to the hybridization solution to reduce the temperature at which hybridization is performed. Background signals may be reduced by the use of detergents such as Sarkosyl or Triton X-100 (Sigma Aldrich, St. Louis Mo.) and a blocking agent such as denatured salmon sperm DNA. Selection of components and conditions for hybridization are well known to those skilled in the art and are reviewed in Ausubel et al. (1997, *Short Protocols in Molecular Biology*, John Wiley & Sons, New York N.Y., Units 2.8–2.11, 3.18–3.19 and 4.6–4.9).

Dot-blot, slot-blot, low density and high density arrays are prepared and analyzed using methods known in the art. cDNAs from about 18 consecutive nucleotides to about 5000 consecutive nucleotides in length are contemplated by the invention and used in array technologies. The preferred number of cDNAs on an array is at least about 100,000, a more preferred number is at least about 40,000, an even more preferred number is at least about 10,000, and a most preferred number is at least about 600 to about 800. The array may be used to monitor the expression level of large numbers of genes simultaneously and to identify genetic variants, mutations, and SNPs. Such information may be used to determine gene function; to understand the genetic basis of a disorder; to diagnose a disorder; and to develop and monitor the activities of therapeutic agents being used to control or cure a disorder. (See, e.g., U.S. Pat. No. 5,474,796; WO95/11995; WO95/35505; U.S. Pat. Nos. 5,605,662; and 5,958,342.)

Screening and Purification Assays

A cDNA may be used to screen a library or a plurality of molecules or compounds for a ligand which specifically binds the cDNA. Ligands may be DNA molecules, RNA molecules, peptide nucleic acid molecules, peptides, proteins such as transcription factors, promoters, enhancers, repressors, and other proteins that regulate replication, transcription, or translation of the polynucleotide in the biological system. The assay involves combining the cDNA or a fragment thereof with the molecules or compounds under conditions that allow specific binding and detecting the bound cDNA to identify at least one ligand that specifically binds the cDNA.

In one embodiment, the cDNA may be incubated with a library of isolated and purified molecules or compounds and binding activity determined by methods such as a gel-retardation assay (U.S. Pat. No. 6,010,849) or a reticulocyte lysate transcriptional assay. In another embodiment, the cDNA may be incubated with nuclear extracts from biopsied and/or cultured cells and tissues. Specific binding between the cDNA and a molecule or compound in the nuclear extract is initially determined by gel shift assay. Protein binding may be confirmed by raising antibodies against the protein and adding the antibodies to the gel-retardation assay where specific binding will cause a supershift in the assay.

In another embodiment, the cDNA may be used to purify a molecule or compound using affinity chromatography methods well known in the art. In one embodiment, the cDNA is chemically reacted with cyanogen bromide groups on a polymeric resin or gel. Then a sample is passed over and reacts with or binds to the cDNA. The molecule or compound which is bound to the cDNA may be released from the cDNA by increasing the salt concentration of the flow-through medium and collected.

The cDNA may be used to purify a ligand from a sample. A method for using a cDNA to purify a ligand would involve combining the cDNA or a fragment thereof with a sample under conditions to allow specific binding, recovering the bound cDNA, and using an appropriate agent to separate the cDNA from the purified ligand.

Protein Production and Uses

The full length cDNAs or fragment thereof may be used to produce purified proteins using recombinant DNA technologies described herein and taught in Ausubel et al. (sunra; Units 16.1–16.62). One of the advantages of producing proteins by these procedures is the ability to obtain highly-enriched sources of the proteins thereby simplifying purification procedures.

The proteins may contain amino acid substitutions, deletions or insertions made on the basis of similarity in polarity, charge, solubility, hydrophobicity, hydrophilicity, and/or the amphipathic nature of the residues involved. Such substitutions may be conservative in nature when the substituted residue has structural or chemical properties similar to the original residue (e.g., replacement of leucine with isoleucine or valine) or they may be nonconservative when the replacement residue is radically different (e.g., a glycine replaced by a tryptophan). Computer programs included in LASERGENE software (DNASTAR, Madison Wis.), MACVECTOR software (Genetics Computer Group, Madison Wis.) and RasMol software (Roger Sayles, University of Massachusetts, Amherst Mass.) may be used to help determine which and how many amino acid residues in a particular portion of the protein may be substituted, inserted, or deleted without abolishing biological or immunological activity.

Expression of Encoded Proteins

Expression of a particular cDNA may be accomplished by cloning the cDNA into a vector and transforming this vector into a host cell. The cloning vector used for the construction of cDNA libraries in the LIFESEQ databases may also be used for expression. Such vectors usually contain a promoter and a polylinker useful for cloning, priming, and transcription. An exemplary vector may also contain the promoter for β-galactosidase, an amino-terminal methionine and the subsequent seven amino acid residues of β-galactosidase. The vector may be transformed into competent *E. coli* cells. Induction of the isolated bacterial strain with isopropylthiogalactoside (IPTG) using standard methods will produce a fusion protein that contains an N terminal methionine, the first seven residues of β-galactosidase, about 15 residues of linker, and the protein encoded by the cDNA.

The cDNA may be shuttled into other vectors known to be useful for expression of protein in specific hosts. Oligonucleotides containing cloning sites and fragments of DNA sufficient to hybridize to stretches at both ends of the cDNA may be chemically synthesized by standard methods. These primers may then be used to amplify the desired fragments by PCR. The fragments may be digested with appropriate restriction enzymes under standard conditions and isolated using gel electrophoresis. Alternatively, similar fragments are produced by digestion of the cDNA with appropriate restriction enzymes and filled in with chemically synthesized oligonucleotides. Fragments of the coding sequence from more than one gene may be ligated together and expressed.

Signal sequences that dictate secretion of soluble proteins are particularly desirable as component parts of a recombinant sequence. For example, a chimeric protein may be expressed that includes one or more additional purification-facilitating domains. Such domains include, but are not limited to, metal-chelating domains that allow purification on immobilized metals, protein A domains that allow purification on immobilized immunoglobulin, and the domain utilized in the FLAGS extension/affinity purification system (Immunex, Seattle Wash.). The inclusion of a cleavable-linker sequence such as ENTEROKINASEMAX (Invitrogen, San Diego Calif.) between the protein and the purification domain may also be used to recover the protein.

Suitable host cells may include, but are not limited to, mammalian cells such as Chinese Hamster Ovary (CHO) and human 293 cells, insect cells such as Sf9 cells, plant cells such as *Nicotiana tabacum*, yeast cells such as*Saccharomyces cerevisiae*, and bacteria such as *E. coli*. For each of these cell systems, a useful vector may also include an origin of replication and one or two selectable markers to allow selection in bacteria as well as in a transformed eukaryotic host. Vectors for use in eukaryotic host cells may require the addition of 3'poly(A) tail if the cDNA lacks poly(A).

Additionally, the vector may contain promoters or enhancers that increase gene expression. Many promoters are known and used in the art. Most promoters are host specific and exemplary promoters includes SV40 promoters for CHO cells; T7 promoters for bacterial hosts; viral promoters and enhancers for plant cells; and PGH promoters for yeast. Adenoviral vectors with the rous sarcoma virus enhancer or retroviral vectors with long terminal repeat promoters may be used to drive protein expression in mammalian cell lines. Once homogeneous cultures of recombinant cells are obtained, large quantities of secreted soluble protein may be recovered from the conditioned medium and analyzed using chromatographic methods well known in the art. An alternative method for the production of large amounts of secreted protein involves the transformation of mammalian embryos and the recovery of the recombinant protein from milk produced by transgenic cows, goats, sheep, and the like.

In addition to recombinant production, proteins or portions thereof may be produced manually, using solid-phase techniques (Stewart et al. (1969) *Solid-Phase Peptide Synthesis*, W H Freeman, San Francisco Calif.; Merrifield (1963) J Am Chem Soc 5:2149–2154), or using machines such as the ABI 431A peptide synthesizer (Applied Biosystems, Foster City Calif.). Proteins produced by any of the above methods may be used as pharmaceutical compositions to treat disorders associated with null or inadequate expression of the genomic sequence.

Screening and Purification Assays

A protein or a portion thereof encoded by the cDNA may be used to screen a library or a plurality of molecules or compounds for a ligand with specific binding affinity or to purify a molecule or compound from a sample. The protein or portion thereof employed in such screening may be free in solution, affixed to an abiotic or biotic substrate, or located intracellularly. For example, viable or fixed prokaryotic host cells that are stably transformed with recombinant nucleic acids that have expressed and positioned a protein on their cell surface can be used in screening assays. The cells are screened against a library or a plurality of ligands and the specificity of binding or formation of complexes between the expressed protein and the ligand may be measured. The ligands may be DNA, RNA, or PNA molecules, agonists, antagonists, antibodies, immunoglobulins, inhibitors, peptides, pharmaceutical agents, proteins, drugs, or any other test molecule or compound that specifically binds the protein. An exemplary assay involves combining the mammalian protein or a portion thereof with the molecules or compounds under conditions that allow specific binding and detecting the bound protein to identify at least one ligand that specifically binds the protein.

This invention also contemplates the use of competitive drug screening assays in which neutralizing antibodies capable of binding the protein specifically compete with a test compound capable of binding to the protein or oligopeptide or fragment thereof. One method for high throughput screening using very small assay volumes and very small amounts of test compound is described in U.S. Pat. No. 5,876,946. Molecules or compounds identified by screening may be used in a model system to evaluate their toxicity, diagnostic, or therapeutic potential.

The protein may be used to purify a ligand from a sample. A method for using a protein to purify a ligand would involve combining the protein or a portion thereof with a sample under conditions to allow specific binding, recovering the bound protein, and using an appropriate chaotropic agent to separate the protein from the purified ligand.

Production of Antibodies

A protein encoded by a cDNA of the invention may be used to produce specific antibodies. Antibodies may be produced using an oligopeptide or a portion of the protein with inherent immunological activity. Methods for producing antibodies include: 1) injecting an animal, usually goats, rabbits, or mice, with the protein, or an antigenically-effective portion or an oligopeptide thereof, to induce an immune response; 2) engineering hybridomas to produce monoclonal antibodies; 3) inducing in vivo production in the lymphocyte population; or 4) screening libraries of recombinant immunoglobulins. Recombinant immunoglobulins may be produced as taught in U.S. Pat. No. 4,816,567.

Antibodies produced using the proteins of the invention are useful for the diagnosis of prepathologic disorders as well as the diagnosis of chronic or acute diseases characterized by abnormalities in the expression, amount, or distribution of the protein. A variety of protocols for competitive binding or immunoradiometric assays using either polyclonal or monoclonal antibodies specific for proteins are well known in the art. Immunoassays typically involve the formation of complexes between a protein and its specific binding molecule or compound and the measurement of complex formation. Immunoassays may employ a two-site, monoclonal-based assay that utilizes monoclonal antibodies reactive to two noninterfering epitopes on a specific protein or a competitive binding assay (Pound (1998) *Immunochemical Protocols*, Humana Press, Totowa N.J.).

Immunoassay procedures may be used to quantify expression of the protein in cell cultures, in subjects with a particular disorder or in model animal systems under various conditions. Increased or decreased production of proteins as monitored by immunoassay may contribute to knowledge of the cellular activities associated with developmental pathways, engineered conditions or diseases, or treatment efficacy. The quantity of a given protein in a given tissue may be determined by performing immunoassays on freeze-thawed detergent extracts of biological samples and comparing the slope of the binding curves to binding curves generated by purified protein.

Labeling of Molecules for Assay

A wide variety of reporter molecules and conjugation techniques are known by those skilled in the art and may be used in various cDNA, polynucleotide, protein, peptide or antibody assays. Synthesis of labeled molecules may be achieved using commercial kits for incorporation of a labeled nucleotide such as $^{32}$P-dCTP, Cy3-dCTP or Cy5-dCTP or amino acid such as $^{35}$S-methionine. Polynucleotides, cDNAs, proteins, or antibodies may be directly labeled with a reporter molecule by chemical conjugation to amines, thiols and other groups present in the molecules using reagents such as BIODIPY or FITC (Molecular Probes, Eugene Oreg.).

The proteins and antibodies may be labeled for purposes of assay by joining them, either covalently or noncovalently, with a reporter molecule that provides for a detectable signal. A wide variety of labels and conjugation techniques are known and have been reported in the scientific and patent literature including, but not limited to U.S. Pat. Nos. 3,817, 837; 3,850,752; 3,939,350; 3,996,345; 4,277,437; 4,275, 149; and 4,366,241.

Diagnostics

The cDNAs, or fragments thereof, may be used to detect and quantify differential gene expression; absence, presence, or excess expression of mRNAs; or to monitor mRNA levels during therapeutic intervention. Disorders associated with altered expression include liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease, and toxicological responses to treatment with steroids and steroid antagonists. These cDNAs can also be utilized as markers of treatment efficacy against the disorders noted above and other disorders, conditions, and diseases over a period ranging from several days to months. The diagnostic assay may use hybridization or amplification technology to compare gene expression in a biological sample from a patient to standard samples in order to detect altered gene expression. Qualitative or quantitative methods for this comparison are well known in the art.

For example, the cDNA may be labeled by standard methods and added to a biological sample from a patient under conditions for hybridization complex formation. After an incubation period, the sample is washed and the amount of label (or signal) associated with hybridization complexes is quantified and compared with a standard value. If the amount of label in the patient sample is significantly altered in comparison to the standard value, then the presence of the associated condition, disease or disorder is indicated.

In order to provide a basis for the diagnosis of a condition, disease or disorder associated with gene expression, a normal or standard expression profile is established. This may be accomplished by combining a biological sample taken from normal subjects, either animal or human, with a probe under conditions for hybridization or amplification. Standard hybridization may be quantified by comparing the values obtained using normal subjects with values from an experiment in which a known amount of a substantially purified target sequence is used. Standard values obtained in this manner may be compared with values obtained from samples from patients who are symptomatic for a particular condition, disease, or disorder. Deviation from standard values toward those associated with a particular condition is used to diagnose that condition.

Such assays may also be used to evaluate the efficacy of a particular therapeutic treatment regimen in animal studies and in clinical trial or to monitor the treatment of an individual patient. Once the presence of a condition is established and a treatment protocol is initiated, diagnostic assays may be repeated on a regular basis to determine if the level of expression in the patient begins to approximate that which is observed in a normal subject. The results obtained from successive assays may be used to show the efficacy of treatment over a period ranging from several days to months.

Gene Expression Profiles

A gene expression profile comprises a plurality of cDNAs and a plurality of detectable hybridization complexes, wherein each complex is formed by hybridization of one or more probes to one or more complementary sequences in a sample. The cDNAs of the invention are used as elements on a microarray to analyze gene expression profiles. In one embodiment, the microarray is used to monitor the progression of disease. Researchers can assess and catalog the differences in gene expression between healthy and diseased tissues or cells. By analyzing changes in patterns of gene expression, disease can be diagnosed at earlier stages before the patient is symptomatic. The invention can be used to formulate a prognosis and to design a treatment regimen. The invention can also be used to monitor the efficacy of treatment. For treatments with known side effects, the microarray is employed to improve the treatment regimen. A dosage is established that causes a change in genetic expression patterns indicative of successful treatment. Expression patterns associated with the onset of undesirable side effects are avoided. This approach may be more sensitive and rapid than waiting for the patient to show inadequate improvement, or to manifest side effects, before altering the course of treatment.

In another embodiment, animal models which mimic a human disease can be used to characterize expression profiles associated with a particular condition, disorder or disease; or treatment of the condition, disorder or disease. Novel treatment regimens may be tested in these animal models using microarrays to establish and then follow expression profiles over time. In addition, microarrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Assays Using Antibodies

Antibodies directed against epitopes on a protein encoded by a cDNA of the invention may be used in assays to quantify the amount of protein found in a particular human cell. Such assays include methods utilizing the antibody and a label to detect expression level under normal or disease conditions. The antibodies may be used with or without modification, and labeled by joining them, either covalently or noncovalently, with a labeling moiety.

Protocols for detecting and measuring protein expression using either polyclonal or monoclonal antibodies are well known in the art. Examples include ELISA, RIA, and fluorescent activated cell sorting (FACS). Such immunoassays typically involve the formation of complexes between the protein and its specific antibody and the measurement of such complexes. These and other assays are described in Pound (supra). The method may employ a two-site, monoclonal-based immunoassay utilizing monoclonal antibodies reactive to two non-interfering epitopes, or a competitive binding assay. (See, e.g., Coligan et al. (1997) *Current Protocols in Immunology*, Wiley-Interscience, New York N.Y.; Pound, supra)

Therapeutics

The cDNAs and fragments thereof can be used in gene therapy. cDNAs can be delivered ex vivo to target cells, such as cells of bone marrow. Once stable integration and transcription and or translation are confirmed, the bone marrow may be reintroduced into the subject. Expression of the protein encoded by the cDNA may correct a disorder associated with mutation of a normal sequence, reduction or loss of an endogenous target protein, or overepression of an endogenous or mutant protein. Alternatively, cDNAs may be delivered in vivo using vectors such as retrovirus, adenovirus, adeno-associated virus, herpes simplex virus, and bacterial plasmids. Non-viral methods of gene delivery include cationic liposomes, polylysine conjugates, artificial viral envelopes, and direct injection of DNA (Anderson (1998) Nature 392:25–30; Dachs et al. (1997) Oncol Res 9:313–325; Chu et al. (1998) J Mol Med 76(3–4):184–192; Weiss et al. (1999) Cell Mol Life Sci 55(3):334–358; Agrawal (1996) *Antisense Therapeutics*, Humana Press, Totowa N.J.; and August et al. (1997) *Gene Therapy* (Advances in Pharmacology, Vol. 40), Academic Press, San Diego Calif.).

In addition, expression of a particular protein can be regulated through the specific binding of a fragment of a cDNA to a genomic sequence or an mRNA which encodes the protein or directs its transcription or translation. The cDNA can be modified or derivatized to any RNA-like or DNA-like material including peptide nucleic acids, branched nucleic acids, and the like. These sequences can be produced biologically by transforming an appropriate host cell with a vector containing the sequence of interest.

Molecules which regulate the activity of the cDNA or encoded protein are useful as therapeutics for liver disorders associated with steroid therapy such as adenomatosis, cholestasis, cirrhosis, hemangioma, Henoch-Schonlein purpura, hepatitis, hepatocellular and metastatic carcinomas, idiopathic thrombocytopenic purpura, porphyria, sarcoidosis, and Wilson disease, and for regulating metabolic and toxicological responses to treatment with steroids and steroid antagonists. Such molecules include agonists which increase the expression or activity of the polynucleotide or encoded protein, respectively; or antagonists which decrease expression or activity of the polynucleotide or encoded protein, respectively. In one aspect, an antibody which specifically binds the protein may be used directly as an antagonist or indirectly as a delivery mechanism for bringing a pharmaceutical agent to cells or tissues which express the protein.

Additionally, any of the proteins, or their ligands, or complementary nucleic acid sequences may be administered as pharmaceutical compositions or in combination with other appropriate therapeutic agents. Selection of the appropriate agents for use in combination therapy may be made by one of ordinary skill in the art, according to conventional pharmaceutical principles. The combination of therapeutic agents may act synergistically to affect the treatment or prevention of the conditions and disorders associated with an immune response. Using this approach, one may be able to achieve therapeutic efficacy with lower dosages of each agent, thus reducing the potential for adverse side effects. Further, the therapeutic agents may be combined with pharmaceutically-acceptable carriers including excipients and auxiliaries which facilitate processing of the active compounds into preparations which can be used pharmaceutically. Further details on techniques for formulation and administration used by doctors and pharmacists may be found in the latest edition of *Remington's Pharmaceutical Sciences* (Mack Publishing, Easton Pa.).

Model Systems

Animal models may be used as bioassays where they exhibit a phenotypic response similar to that of humans and where exposure conditions are relevant to human exposures. Mammals are the most common models, and most infectious agent, cancer, drug, and toxicity studies are performed on rodents such as rats or mice because of low cost, availability, lifespan, reproductive potential, and abundant reference literature. Inbred and outbred rodent strains provide a convenient model for investigation of the physiological consequences of underexpression or overexpression of genes of interest and for the development of methods for diagnosis and treatment of diseases. A mammal inbred to overexpress a particular gene (for example, secreted in milk) may also serve as a convenient source of the protein expressed by that gene.

Transgenic Animal Models

Transgenic rodents that overexpress or underexpress a gene of interest may be inbred and used to model human diseases or to test therapeutic or toxic agents. (See, e.g., U.S. Pat. Nos. 5,175,383 and 5,767,337.) In some cases, the introduced gene may be activated at a specific time in a specific tissue type during fetal or postnatal development. Expression of the transgene is monitored by analysis of phenotype, of tissue-specific mRNA expression, or of serum and tissue protein levels in transgenic animals before, during, and after challenge with experimental drug therapies.

Embryonic Stem Cells

Embryonic (ES) stem cells isolated from rodent embryos retain the potential to form embryonic tissues. When ES cells such as the mouse 129/SvJ cell line are placed in a blastocyst from the C57BL/6 mouse strain, they resume normal development and contribute to tissues of the live-born animal. ES cells are preferred for use in the creation of experimental knockout and knockin animals. The method for this process is well known in the art and the steps are: the cDNA is introduced into a vector, the vector is transformed into ES cells, transformed cells are identified and microinjected into mouse cell blastocysts, blastocysts are surgically transferred to pseudopregnant dams. The resulting chimeric progeny are genotyped and bred to produce heterozygous or homozygous strains.

Knockout Analysis

In gene knockout analysis, a region of a gene is enzymatically modified to include a non-natural intervening sequence such as the neomycin phosphotransferase gene (neo; Capecchi (1989) Science 244:1288–1292). The modified gene is transformed into cultured ES cells and integrates into the endogenous genome by homologous recombination. The inserted sequence disrupts transcription and translation of the endogenous gene.

Knockin Analysis

ES cells can be used to create knockin humanized animals or transgenic animal models of human diseases. With knockin technology, a region of a human gene is injected into animal ES cells, and the human sequence integrates into the animal cell genome. Transgenic progeny or inbred lines are studied and treated with potential pharmaceutical agents to obtain information on the progression and treatment of the analogous human condition.

As described herein, the uses of the cDNAs, provided in the Sequence Listing of this application, and their encoded proteins are exemplary of known techniques and are not intended to reflect any limitation on their use in any technique that would be known to the person of average skill in the art. Furthermore, the cDNAs provided in this application may be used in molecular biology techniques that have not yet been developed, provided the new techniques rely on properties of nucleotide sequences that are currently known to the person of ordinary skill in the art, e.g., the triplet genetic code, specific base pair interactions, and the like. Likewise, reference to a method may include combining more than one method for obtaining or assembling full length cDNA sequences that will be known to those skilled in the art. It is also to be understood that this invention is not limited to the particular methodology, protocols, and reagents described, as these may vary. It is also understood that the terminology used herein is for the purpose of describing particular embodiments only, and is not intended to limit the scope of the present invention which will be limited only by the appended claims. The examples below are provided to illustrate the subject invention and are not included for the purpose of limiting the invention.

EXAMPLES

I Construction of cDNA Libraries

RNA was purchased from Clontech Laboratories (Palo Alto Calif.) or isolated from various tissues. Some tissues were homogenized and lysed in guanidinium isothiocyanate, while others were homogenized and lysed in phenol or in a suitable mixture of denaturants, such as TRIZOL reagent (Life Technologies, Rockville Md.). The resulting lysates were centrifuged over CsCl cushions or extracted with chloroform. RNA was precipitated with either isopropanol or ethanol and sodium acetate, or by other routine methods.

Phenol extraction and precipitation of RNA were repeated as necessary to increase RNA purity. In most cases, RNA was treated with DNAse. For most libraries, poly(A) RNA was isolated using oligo d(T)-coupled paramagnetic particles (Promega), OLIGOTEX latex particles (Qiagen, Valencia Calif.), or an OLIGOTEX mRNA purification kit (Qiagen). Alternatively, poly(A) RNA was isolated directly from tissue lysates using other kits, including the POLY(A) PURE mRNA purification kit (Ambion, Austin Tex.).

In some cases, Stratagene (La Jolla Calif.) was provided with RNA and constructed the corresponding cDNA libraries. Otherwise, cDNA was synthesized and cDNA libraries were constructed with the UNIZAP vector system (Stratagene) or SUPERSCRIPT plasmid system (Life Technologies) using the recommended procedures or similar methods known in the art. (See Ausubel, supra, Units 5.1 through 6.6.) Reverse transcription was initiated using oligo d(T) or random primers. Synthetic oligonucleotide adapters were ligated to double stranded cDNA, and the cDNA was digested with the appropriate restriction enzyme or enzymes. For most libraries, the cDNA was size-selected (300–1000 bp) using SEPHACRYL S1000, SEPHAROSE CL2B, or SEPHAROSE CL4B column chromatography (APB) or preparative agarose gel electrophoresis. cDNAs were ligated into compatible restriction enzyme sites of the polylinker of the pBLUESCRIPT phagemid (Stratagene), pSPORT1 plasmid (Life Technologies), or pINCY plasmid (Incyte Genomics, Palo Alto Calif.). Recombinant plasmids were transformed into XL1-BLUE, XL1-BLUEMRF, or SOLR competent *E. coli* cells (Stratagene) or DH5α, DH10B, or ELECTROMAX DH10B competent *E. coli* cells (Life Technologies).

In some cases, libraries were superinfected with a 5× excess of the helper phage, M13K07, according to the method of Vieira et al. (1987, Methods Enzymol. 153:3–11) and normalized or subtracted using a methodology adapted from Soares (1994, Proc Natl Acad Sci 91:9228–9232), Swaroop et al. (1991, Nucleic Acids Res 19:1954), and Bonaldo et al. (1996, Genome Research 6:791–806). The modified Soares normalization procedure was utilized to reduce the repetitive cloning of highly expressed high abundance cDNAs while maintaining the overall sequence complexity of the library. Modification included significantly longer hybridization times which allowed for increased gene discovery rates by biasing the normalized libraries toward those infrequently expressed low-abundance cDNAs which are poorly represented in a standard transcript image (Soares et al., supra).

II Isolation and Sequencing of cDNA Clones

Plasmids were recovered from host cells by in vivo excision using the UNIZAP vector system (Stratagene) or by cell lysis. Plasmids were purified using one of the following: the Magic or WIZARD MINIPREPS DNA purification system (Promega); the AGTC MINIPREP purification kit (Edge BioSystems, Gaithersburg Md.); the QIAWELL 8, QIAWELL 8 Plus, or QIAWELL 8 Ultra plasmid purification systems, or the REAL PREP 96 plasmid purification kit (Qiagen). Following precipitation, plasmids were resuspended in 0.1 ml of distilled water and stored, with or without lyophilization, at 4° C.

Alternatively, plasmid DNA was amplified from host cell lysates using direct link PCR in a high-throughput format (Rao (1994) Anal Biochem 216:1–14). Host cell lysis and thermal cycling steps were carried out in a single reaction mixture. Samples were processed and stored in 384-well plates, and the concentration of amplified plasmid DNA was quantified fluorometrically using PICOGREEN dye (Molecular Probes) and a FLUOROSKAN II fluorescence scanner (Labsystems Oy, Helsinki, Finland).

cDNA sequencing reactions were processed using standard methods or high-throughput instrumentation such as the ABI CATALYST 800 thermal cycler (Applied Biosystems) or the DNA ENGINE thermal cycler (MJ Research, Watertown Mich.) in conjunction with the HYDRA microdispenser (Robbins Scientific, Sunnyvale Calif.) or the MICROLAB 2200 system (Hamilton, Reno Nev). cDNA sequencing reactions were prepared using reagents provided by APB or supplied in ABI sequencing kits such as the ABI PRISM BIGDYE cycle sequencing kit (Applied Biosystems). Electrophoretic separation of cDNA sequencing reactions and detection of labeled cDNAs were carried out using the MEGABACE 1000 DNA sequencing system (APB); the ABI PRISM 373 or 377 sequencing systems (Applied Biosystems) in conjunction with standard ABI protocols and base calling software; or other sequence analysis systems known in the art. Reading frames within the cDNA sequences were identified using standard methods (reviewed in Ausubel, supra, Unit 7.7).

III Extension of cDNA Sequences

Nucleic acid sequences were extended using the cDNA clones and oligonucleotide primers. One primer was synthesized to initiate 5' extension of the known fragment, and the other, to initiate 3' extension of the known fragment. The initial primers were designed using OLIGO primer analysis software (Molecular Biology Insights, Cascade Colo.), or another appropriate program, to be about 22 to 30 nucleotides in length, to have a GC content of about 50% or more, and to anneal to the target sequence at temperatures of about 68° C. to about 72° C. Any stretch of nucleotides which would result in hairpin structures and primer-primer dimerizations was avoided.

Selected human cDNA libraries were used to extend the sequence. If more than one extension was necessary or desired, additional or nested sets of primers were designed. Preferred libraries are ones that have been size-selected to include larger cDNAs. Also, random primed libraries are preferred because they will contain more sequences with the 5' and upstream regions of genes. A randomly primed library is particularly useful if an oligo d(T) library does not yield a full-length cDNA.

High fidelity amplification was obtained by PCR using methods well known in the art. PCR was performed in 96-well plates using the DNA ENGINE thermal cycler (MJ Research). The reaction mix contained DNA template, 200 nmol of each primer, reaction buffer containing $Mg^{2+}$, $(NH_4)_2SO_4$, and β-mercaptoethanol, Taq DNA polymerase (APB), ELONGASE enzyme (Life Technologies), and Pfu DNA polymerase (Stratagene), with the following parameters for primer pair PCI A and PCI B (Incyte Genomics): Step 1: 94° C., 3 min; Step 2: 94° C., 15 sec; Step 3: 60° C., 1 min; Step 4: 68° C., 2 min; Step 5: Steps 2, 3, and 4 repeated 20 times; Step 6: 68° C., 5 min; Step 7: storage at 4° C. In the alternative, the parameters for primer pair T7 and SK+(Stratagene) were as follows: Step 1: 94° C., 3 min; Step 2: 94° C., 15 sec; Step 3: 57° C., 1 min; Step 4: 68° C., 2 min; Step 5: Steps 2, 3, and 4 repeated 20 times; Step 6: 68° C., 5 min; Step 7: storage at 4° C.

The concentration of DNA in each well was determined by dispensing 100 μl PICOGREEN reagent (0.25% reagent in 1×TE, v/v; Molecular Probes) and 0.5 μl of undiluted PCR product into each well of an opaque fluorimeter plate (Corning Costar, Acton Mich.) and allowing the DNA to bind to the reagent. The plate was scanned in a FLUOROSKAN II (Labsystems Oy) to measure the fluorescence of the sample and to quantify the concentration of DNA. A 5 μl to 10 μl aliquot of the reaction mixture was analyzed by electrophoresis on a 1% agarose mini-gel to determine which reactions were successful in extending the sequence.

The extended nucleic acids were desalted and concentrated, transferred to 384-well plates, digested with CviJI cholera virus endonuclease (Molecular Biology Research, Madison Wis.), and sonicated or sheared prior to religation into pUC18 vector (APB). For shotgun sequencing, the digested nucleic acids were separated on low concentration (0.6 to 0.8%) agarose gels, fragments were excised, and agar digested with AGARACE enzyme (Promega). Extended clones were religated using T4 DNA ligase (New England Biolabs, Beverly Mich.) into pUC18 vector (APB), treated with Pfu DNA polymerase (Stratagene) to fill-in restriction site overhangs, and transformed into competent E. coli cells. Transformed cells were selected on antibiotic-containing media, and individual colonies were picked and cultured overnight at 37° C. in 384-well plates in LB/2×carbenicillin liquid media.

The cells were lysed, and DNA was amplified by PCR using Taq DNA polymerase (APB) and Pfu DNA polymerase (Stratagene) with the following parameters: Step 1: 94° C., 3 min; Step 2: 94° C., 15 sec; Step 3: 60° C., 1 min; Step 4: 72° C., 2 min; Step 5: steps 2, 3, and 4 repeated 29 times; Step 6: 72° C., 5 min; Step 7: storage at 4° C. DNA was quantified using PICOGREEN reagent (Molecular Probes) as described above. Samples with low DNA recoveries were reamplified using the same conditions described above. Samples were diluted with 20% dimethylsulfoxide (DMSO; 1:2, v/v), and sequenced using DYENAMIC energy transfer sequencing primers and the DYENAMIC DIRECT cycle sequencing kit (APB) or the ABI PRISM BIGDYE terminator cycle sequencing kit (Applied Biosystems).

IV Assembly and Analysis of Sequences

Component nucleotide sequences from chromatograms were subjected to PHRED analysis (Phil Green, University of Washington, Seattle Wash.) and assigned a quality score. The sequences having at least a required quality score were subject to various pre-processing algorithms to eliminate low quality 3' ends, vector and linker sequences, polyA tails, Alu repeats, mitochondrial and ribosomal sequences, bacterial contamination sequences, and sequences smaller than 50 base pairs. Sequences were screened using the BLOCK 2 program (Incyte Genomics), a motif analysis program based on sequence information contained in the SWISS-PROT and PROSITE databases (Bairoch et al. (1997) Nucleic Acids Res 25:217–221; Attwood et al. (1997) J Chem Inf Comput Sci 37:417–424).

Processed sequences were subjected to assembly procedures in which the sequences were assigned to bins, one sequence per bin. Sequences in each bin were assembled to produce consensus sequences, templates. Subsequent new sequences were added to existing bins using BLAST (Altschul (supra); Altschul et al. (supra); Karlin et al. (1988) Proc Natl Acad Sci 85:841–845), BLASTn (vers.1.4, WashU), and CROSSMATCH software (Phil Green, supra). Candidate pairs were identified as all BLAST hits having a quality score greater than or equal to 150. Alignments of at least 82% local identity were accepted into the bin. The component sequences from each bin were assembled using PHRAP (Phil Green, supra). Bins with several overlapping component sequences were assembled using DEEP PHRAP (Phil Green, supra).

Bins were compared against each other, and those having local similarity of at least 82% were combined and reassembled. Reassembled bins having templates of insufficient overlap (less than 95% local identity) were re-split. Assembled templates were also subjected to analysis by STITCHER/EXON MAPPER algorithms which analyzed the probabilities of the presence of splice variants, alternatively spliced exons, splice junctions, differential expression of alternative spliced genes across tissue types, disease states, and the like. These resulting bins were subjected to several rounds of the above assembly procedures to generate the template sequences found in the LWESEQ GOLD database (Incyte Genomics).

The assembled templates were annotated using the following procedure. Template sequences were analyzed using BLASTn (vers. 2.0, NCBI) versus GBpri (GenBank vers. 117). "Hits" were defined as an exact match having from 95% local identity over 200 base pairs through 100% local identity over 100 base pairs, or a homolog match having an E-value equal to or greater than $1\times10^{-8}$. (The "E-value" quantifies the statistical probability that a match between two sequences occurred by chance). The hits were subjected to frameshift FASTx versus GENPEPT (GenBank version 109). In this analysis, a homolog match was defined as having an E-value of $1\times10^{-8}$. The assembly method used above was described in U.S. Ser. No. 09/276,534, filed Mar. 25, 1999, and the LIFESEQ GOLD user manual (Incyte Genomics).

Following assembly, template sequences were subjected to motif, BLAST, Hidden Markov Model (HMM; Pearson and Lipman (1988) Proc Natl Acad Sci 85:2444–2448; Smith and Waterman (1981) J Mol Biol 147:195–197), and functional analyses, and categorized in protein hierarchies using methods described in U.S. Ser. No. 08/812,290, filed Mar. 6, 1997; U.S. Ser. No. 08/947,845, filed Oct. 9, 1997; U.S. Pat. No. 5,953,727; and U.S. Ser. No. 09/034,807, filed Mar. 4, 1998. Template sequences may be further queried against public databases such as the GenBank rodent, mammalian, vertebrate, eukaryote, prokaryote, and human EST databases.

V Selection of Sequences, Microarray Preparation and Use

Incyte clones represent template sequences derived from the LWESEQ GOLD assembled human sequence database (Incyte Genomics). In cases where more than one clone was available for a particular template, the 5'-most clone in the template was used on the microarray. The HUMAN GENOME GEM series 1–4 microarrays (Incyte Genomics) contain 28,626 array elements which represent 10,068 annotated clusters and 18,558 unannotated clusters. For the UNIGEM series microarrays (Incyte Genomics), Incyte clones were mapped to non-redundant Unigene clusters (Unigene database (build 46), NCBI; Shuler (1997) J Mol Med 75:694–698), and the 5' clone with the strongest BLAST alignment (at least 90% identity and 100 bp overlap) was chosen, verified, and used in the construction of the microarray. The UNIGEM V microarray (Incyte Genomics) contains 7075 array elements which represent 4610 annotated genes and 2,184 unannotated clusters. Table 1 shows the GenBank annotations for the polynucleotide sequences selected from SEQ ID NOs: 1–1143 of this invention as produced by BLAST analysis.

To construct microarrays, cDNAs were amplified from bacterial cells using primers complementary to vector sequences flanking the cDNA insert. Thirty cycles of PCR increased the initial quantity of cDNAs from 1–2 ng to a final quantity greater than 5 μg. Amplified cDNAs were then purified using SEPHACRYL-400 columns (APB). Purified cDNAs were immobilized on polymer-coated glass slides. Glass microscope slides (Corning, Corning N.Y.) were cleaned by ultrasound in 0.1% SDS and acetone, with extensive distilled water washes between and after treatments. Glass slides were etched in 4% hydrofluoric acid (VWR Scientific Products, West Chester Pa.), washed thoroughly in distilled water, and coated with 0.05% aminopropyl silane (Sigma Aldrich) in 95% ethanol. Coated slides were cured in a 110° C. oven. cDNAs were applied to the coated glass substrate using a procedure described in U.S. Pat. No. 5,807,522. One microliter of the cDNA at an average concentration of 100 ng/μl was loaded into the open capillary printing element by a high-speed robotic apparatus which then deposited about 5 nl of cDNA per slide.

Microarrays were UV-crosslinked using a STRATALINKER UV-crosslinker (Stratagene), and then washed at room temperature once in 0.2% SDS and three times in distilled water. Non-specific binding sites were blocked by incubation of microarrays in 0.2% casein in phosphate buffered saline (Tropix, Bedford Mich.) for 30 minutes at 60° C. followed by washes in 0.2% SDS and distilled water as before.

VI Preparation of Samples

Steroid Treatment of Human Liver C3A Cells

Early confluent C3A cells were treated with mifepristone, progesterone, beclomethasone, medroxyprogesterone, budesonide, prednisone, dexamethasone, betamethasone, or danazol at concentrations of 1 μM, 10 μM, and 100 μM for 1, 3, and 6 hours. In all cases, mRNA from untreated early confluent C3A cells were prepared in parallel as described below.

Isolation and Labeling of Sample cDNAs

Cells were harvested and lysed in 1 ml of TRIZOL reagent ($5\times10^6$ cells/ml; Life Technologies). Lysates were vortexed thoroughly, incubated at room temperature for 2–3 minutes, and extracted with 0.5 ml chloroform. The extract was mixed, incubated at room temperature for 5 minutes, and centrifuged at 15,000 rpm for 15 minutes at 4° C. The aqueous layer was collected, and an equal volume of isopropanol was added. Samples were mixed, incubated at room temperature for 10 minutes, and centrifuged at 15,000 rpm for 20 minutes at 4° C. The supernatant was removed, and the RNA pellet was washed with 1 ml of 70% ethanol, centrifuged at 15,000 rpm at 4° C., and resuspended in RNAse-free water. The concentration of the RNA was determined by measuring the optical density at 260 nm.

Poly(A) RNA was prepared using an OLIGOTEX mRNA kit (Qiagen) with the following modifications: OLIGOTEX beads were washed in tubes instead of on spin columns, resuspended in elution buffer, and then loaded onto spin columns to recover mRNA. To obtain maximum yield, the mRNA was eluted twice.

Each poly(A) RNA sample was reverse transcribed using MMLV reverse-transcriptase, 0.05 pg/μl oligo-d(T) primer (21mer), 1× first strand buffer, 0.03 units/ul RNAse inhibitor, 500 uM dATP, 500 uM dGTP, 500 uM dTTP, 40 uM dCTP, and 40 uM either dCTP-Cy3 or dCTP-Cy5 (APB). The reverse transcription reaction was performed in a 25 ml volume containing 200 ng poly(A) RNA using the GEMBRIGHT kit (Incyte Genomics). Specific control poly (A) RNAs (YCFR06, YCFR45, YCFR67, YCFR85, YCFR43, YCFR22, YCFR23, YCFR25, YCFR44, YCFR26) were synthesized by in vitro transcription from non-coding yeast genomic DNA (W. Lei, unpublished). As quantitative controls, control mRNAs (YCFR06, YCFR45, YCFR67, and YCFR85) at 0.002 ng, 0.02 ng, 0.2 ng, and 2 ng were diluted into reverse transcription reaction at ratios of 1:100,000, 1:10,000, 1:1000, 1:100 (w/w) to sample mRNA, respectively. To sample differential expression patterns, control mRNAs (YCFR43, YCFR22, YCFR23, YCFR25, YCFR44, YCFR26) were diluted into reverse transcription reaction at ratios of 1:3, 3:1, 1:10, 10:1, 1:25, 25:1 (w/w) to sample mRNA. Reactions were incubated at 37° C. for 2 hr, treated with 2.5 ml of 0.5M sodium hydroxide, and incubated for 20 minutes at 85° C. to the stop the reaction and degrade the RNA.

cDNAs were purified using two successive CHROMA SPIN 30 gel filtration spin columns (Clontech). Cy3- and Cy5-labeled reaction samples were combined as described below and ethanol-precipitated using 1 ml of glycogen (1 mg/ml), 60 ml sodium acetate, and 300 ml of 100% ethanol. The cDNAs were then dried to completion using a SpeedVAC system (Savant Instruments, Holbrook N.Y.) and resuspended in 14 μl 5×SSC/0.2% SDS.

VII Hybridization and Detection

Hybridization reactions contained 9 μl of sample mixture containing 0.2 μg each of Cy3 and Cy5 labeled cDNA synthesis products in 5×SSC, 0.2% SDS hybridization buffer. The mixture was heated to 65° C. for 5 minutes and was aliquoted onto the microarray surface and covered with an 1.8 cm² coverslip. The microarrays were transferred to a waterproof chamber having a cavity just slightly larger than a microscope slide. The chamber was kept at 100% humidity internally by the addition of 140 μl of 5×SSC in a corner of the chamber. The chamber containing the microarrays was incubated for about 6.5 hours at 60° C. The microarrays were washed for 10 min at 45° C. in low stringency wash buffer (1×SSC, 0.1% SDS), three times for 10 minutes each at 45° C. in high stringency wash buffer (0.1×SSC), and dried.

Reporter-labeled hybridization complexes were detected with a microscope equipped with an Innova 70 mixed gas 10 W laser (Coherent, Santa Clara Calif.) capable of generating spectral lines at 488 nm for excitation of Cy3 and at 632 nm for excitation of Cy5. The excitation laser light was focused on the microarray using a 20× microscope objective (Nikon, Melville N.Y.). The slide containing the microarray was placed on a computer-controlled X-Y stage on the microscope and raster-scanned past the objective. The 1.8 cm×1.8 cm microarray used in the present example was scanned with a resolution of 20 micrometers.

In two separate scans, the mixed gas multiline laser excited the two fluorophores sequentially. Emitted light was split, based on wavelength, into two photomultiplier tube detectors (PMT R1477; Hamamatsu Photonics Systems, Bridgewater N.J.) corresponding to the two fluorophores. Appropriate filters positioned between the microarray and the photomultiplier tubes were used to filter the signals. The emission maxima of the fluorophores used were 565 nm for Cy3 and 650 nm for Cy5. Each microarray was typically scanned twice, one scan per fluorophore using the appropriate filters at the laser source, although the apparatus was capable of recording the spectra from both fluorophores simultaneously.

The sensitivity of the scans was calibrated using the signal intensity generated by a cDNA control species. Samples of the calibrating cDNA were separately labeled with the two fluorophores and identical amounts of each were added to the hybridization mixture. A specific location on the microarray contained a complementary DNA sequence, allowing the intensity of the signal at that location to be correlated with a weight ratio of hybridizing species of 1:100,000.

The output of the photomultiplier tube was digitized using a 12-bit RTI-835H analog-to-digital (A/D) conversion board (Analog Devices, Norwood, Mich.) installed in an IBM-compatible PC computer. The digitized data were displayed as an image where the signal intensity was mapped using a linear 20-color transformation to a pseudocolor scale ranging from blue (low signal) to red (high signal). The data was also analyzed quantitatively. Where two different fluorophores were excited and measured simultaneously, the data were first corrected for optical crosstalk (due to overlapping emission spectra) between the fluorophores using each fluorophore's emission spectrum.

A grid was superimposed over the fluorescence signal image such that the signal from each spot was centered in each element of the grid. The fluorescence signal within each element was then integrated to obtain a numerical value corresponding to the average intensity of the signal. The software used for signal analysis was the GEMTOOLS gene expression analysis program (Incyte Genomics). Significance was defined as signal to background ratio exceeding 2× and area hybridization exceeding 40%.

VIII Data Analysis and Results

Array elements that exhibited at least 2.5-fold change in expression at one or more time points, a signal intensity over 250 units, a signal-to-background ratio of at least 2.5, and an element spot size of at least 40% were identified as differentially expressed using the GEMTOOLS program (Incyte Genomics). Differential expression values were converted to log base 2 scale. The cDNAs that are differentially expressed are shown in Tables 1–14. Table 1 identifies upregulated and downregulated cDNAs. The cDNAs are identified by their SEQ ID NO and TEMPLATE ID, and by the description associated with at least a fragment of a polynucleotide found in GenBank. The descriptions were obtained using the sequences of the Sequence Listing and BLAST analysis. Tables 6–14 show differential expression values for each clone differentially regulated in the experiment.

An agglomerative cluster analysis was used to identify the typical response patterns and establish the relationships between the different gene expression profiles. Each gene measurement was first normalized by dividing the expression ratios by the maximum value for each time series. To emphasize the variation from one time point to the next, slopes were added to the expression vectors by taking the expression differences between consecutive time points. The Euclidean distance was used as a similarity measure for the expression responses.

The agglomerative algorithm employed constructs a dendrogram. Starting with N clusters each containing a single gene, at each step in the iteration the two closest clusters were merged into a larger cluster. The distance between clusters was defined as the distance between their average expression patterns. After N−1 steps all the data points were merged together. The clustering process defines a hierarchical tree. Genes were automatically assigned to a cluster by cutting the tree between the root and each gene branch with a set of 10 lines ("branch levels") separated by fixed distances. The branch level cut-off forms a cluster. The tree was first 'normalized' so that each branch was at the same distance from the root. In order to preserve the distance between the closest genes, the tree was distorted at the branch furthest from the leaf. The number of branches intersecting at each branch level of the tree equals the number of clusters at that level.

IX Other Hybridization Technologies and Analyses

Other hybridization technologies utilize a variety of substrates such as nylon membranes, capillary tubes, etc. Arranging cDNAs on polymer coated slides is described in Example V; sample cDNA preparation and hybridization and analysis using polymer coated slides is described in examples VI and VII, respectively.

The cDNAs are applied to a membrane substrate by one of the following methods. A mixture of cDNAs is fractionated by gel electrophoresis and transferred to a nylon membrane by capillary transfer. Alternatively, the cDNAs are individually ligated to a vector and inserted into bacterial host cells to form a library. The cDNAs are then arranged on a substrate by one of the following methods. In the first method, bacterial cells containing individual clones are robotically picked and arranged on a nylon membrane. The membrane is placed on LB agar containing selective agent (carbenicillin, kanamycin, ampicillin, or chloramphenicol depending on the vector used) and incubated at 37° C. for 16 hr. The membrane is removed from the agar and consecutively placed colony side up in 10% SDS, denaturing solution (1.5 M NaCl, 0.5 M NaOH ), neutralizing solution (1.5 M NaCl, 1 M Tris, pH 8.0), and twice in 2×SSC for 10 min each. The membrane is then TV irradiated in a STRATALINKER UV-crosslinker (Stratagene).

In the second method, cDNAs are amplified from bacterial vectors by thirty cycles of PCR using primers complementary to vector sequences flanking the insert. PCR amplification increases a starting concentration of 1–2 ng nucleic acid to a final quantity greater than 5 µg. Amplified nucleic acids from about 400 bp to about 5000 bp in length are purified using SEPHACRYL-400 beads (APB). Purified nucleic acids are arranged on a nylon membrane manually or using a dot/slot blotting manifold and suction device and are immobilized by denaturation, neutralization, and UV irradiation as described above.

Hybridization probes derived from cDNAs of the Sequence Listing are employed for screening cDNAs, mRNAs, or genomic DNA in membrane-based hybridizations. Probes are prepared by diluting the cDNAs to a concentration of 40–50 ng in 45 µl TE buffer, denaturing by heating to 100° C. for five min and briefly centrifuging. The denatured cDNA is then added to a REDIPRIME tube (APB), gently mixed until blue color is evenly distributed, and briefly centrifuged. Five microliters of [$^{32}$P]dCTP is added to the tube, and the contents are incubated at 37° C. for 10 min. The labeling reaction is stopped by adding 5 µl of 0.2M EDTA, and probe is purified from unincorporated nucleotides using a PROBEQUANT G-50 microcolumn (APB). The purified probe is heated to 100° C. for five min and then snap cooled for two min on ice.

Membranes are pre-hybridized in hybridization solution containing 1% Sarkosyl and 1× high phosphate buffer (0.5 M NaCl, 0.1 M Na$_2$HPO$_4$, 5 mM EDTA, pH 7) at 55° C. for two hr. The probe, diluted in 15 ml fresh hybridization solution, is then added to the membrane. The membrane is hybridized with the probe at 55° C. for 16 hr. Following hybridization, the membrane is washed for 15 min at 25° C. in 1 mM Tris (pH 8.0), 1% Sarkosyl, and four times for 15 min each at 25° C. in 1 mM Tris (pH 8.0). To detect hybridization complexes, XOMAT-AR film (Eastman Kodak, Rochester N.Y.) is exposed to the membrane overnight at −70° C., developed, and examined.

X Further Characterization of Differentially Expressed cDNAs and Proteins

Clones were blasted against the LIFESEQ Gold 5.1 database (Incyte Genomics) and an Incyte template and its sequence variants were chosen for each clone. The template and variant sequences were blasted against GenBank database to acquire annotation. The nucleotide sequences were translated into amino acid sequence which was blasted against the GenPept and other protein databases to acquire annotation and characterization, i.e., structural motifs.

Percent sequence identity can be determined electronically for two or more amino acid or nucleic acid sequences using the MEGALIGN program (DNASTAR). The percent identity between two amino acid sequences is calculated by dividing the length of sequence A, minus the number of gap residues in sequence A, minus the number of gap residues in sequence B, into the sum of the residue matches between sequence A and sequence B, times one hundred. Gaps of low or of no homology between the two amino acid sequences are not included in determining percentage identity.

Sequences with conserved protein motifs may be searched using the BLOCKS search program. This program analyses sequence information contained in the Swiss-Prot and PROSITE databases and is useful for determining the classification of uncharacterized proteins translated from genomic or cDNA sequences (Bairoch et al.(supra); Attwood et al. (supra). PROSITE database is a useful source for identifying functional or structural domains that are not detected using motifs due to extreme sequence divergence. Using weight matrices, these domains are calibrated against the SWISS-PROT database to obtain a measure of the chance distribution of the matches.

The PRINTS database can be searched using the BLIMPS search program to obtain protein family "fingerprints". The PRINTS database complements the PROSITE database by exploiting groups of conserved motifs within sequence alignments to build characteristic signatures of different protein families. For both BLOCKS and PRINTS analyses, the cutoff scores for local similarity were: >1300=strong, 1000–1300=suggestive; for global similarity were: p<exp−3; and for strength (degree of correlation) were: >1300= strong, 1000–1300=weak.

XI Expression of the Encoded Protein

Expression and purification of a protein encoded by a cDNA of the invention is achieved using bacterial or virus-based expression systems. For expression in bacteria, cDNA is subcloned into a vector containing an antibiotic resistance gene and an inducible promoter that directs high levels of cDNA transcription. Examples of such promoters include, but are not limited to, the trp-lac (tac) hybrid promoter and the T5 or T7 bacteriophage promoter in conjunction with the lac operator regulatory element. Recombinant vectors are transformed into bacterial hosts, such as BL21(DE3). Antibiotic resistant bacteria express the protein upon induction with IPTG. Expression in eukaryotic cells is achieved by infecting *Spodoptera frugiperda* (Sf9) insect cells with recombinant baculovirus, *Autographica californica* nuclear polyhedrosis virus. The polyhedrin gene of baculovinis is replaced with the cDNA by either homologous recombination or bacterial-mediated transposition involving transfer plasmid intermediates. Viral infectivity is maintained and the strong polyhedrin promoter drives high levels of transcription.

For ease of purification, the protein is synthesized as a fusion protein with glutathione-S-transferase (GST; APB) or a similar alternative such as FLAG. The fusion protein is purified on immobilized glutathione under conditions that maintain protein activity and antigenicity. After purification, the GST moiety is proteolytically cleaved from the protein with thrombin. A fusion protein with FLAG, an 8-amino acid peptide, is purified using commercially available monoclonal and polyclonal anti-FLAG antibodies (Eastman Kodak, Rochester N.Y.).

XII Production of Specific Antibodies

A denatured protein from a reverse phase HPLC separation is obtained in quantities up to 75 mg. This denatured protein is used to immunize mice or rabbits following standard protocols. About 100 µg is used to immunize a mouse, while up to 1 mg is used to immunize a rabbit. The denatured protein is radioiodinated and incubated with murine B-cell hybridomas to screen for monoclonal antibodies. About 20 mg of protein is sufficient for labeling and screening several thousand clones.

In another approach, the amino acid sequence translated from a cDNA of the invention is analyzed using PROTEAN software (DNASTAR) to determine regions of high antigenicity, essentially antigenically-effective epitopes of the protein. The optimal sequences for immunization are usually at the C-terminus, the N-terminus, and those intervening, hydrophilic regions of the protein that are likely to be exposed to the external environment when the protein is in its natural conformation. Typically, oligopeptides about 15 residues in length are synthesized using an ABI 431 peptide synthesizer (Applied Biosystems) using Fmoc-chemistry and then coupled to keyhole limpet hemocyanin (KLH; Sigma Aldrich) by reaction with M-maleimidobenzoyl-N-hydroxysuccinimide ester. If necessary, a cysteine may be introduced at the N-terminus of the peptide to permit coupling to KLH. Rabbits are immunized with the oligopeptide-KLH complex in complete Freund's adjuvant. The resulting antisera are tested for antipeptide activity by binding the peptide to plastic, blocking with 1% BSA, reacting with rabbit antisera, washing, and reacting with radioiodinated goat anti-rabbit IgG.

Hybridomas are prepared and screened using standard techniques. Hybridomas of interest are detected by screening with radioiodinated protein to identify those fusions producing a monoclonal antibody specific for the protein. In a typical protocol, wells of 96 well plates (FAST, Becton-Dickinson, Palo Alto Calif.) are coated with affinity-purified, specific rabbit-anti-mouse (or suitable anti-species Ig) antibodies at 10 mg/ml. The coated wells are blocked with 1% BSA and washed and exposed to supernatants from hybridomas. After incubation, the wells are exposed to radiolabeled protein at 1 mg/ml. Clones producing antibodies bind a quantity of labeled protein that is detectable above background.

Such clones are expanded and subjected to 2 cycles of cloning at 1 cell/3 wells. Cloned hybridomas are injected into pristane-treated mice to produce ascites, and monoclonal antibody is purified from the ascitic fluid by affinity chromatography on protein A (APB). Monoclonal antibodies with affinities of at least $10^8$ $M^{-1}$, preferably $10^9$ to $10^{10}$ $M^{-1}$ or stronger, are made by procedures well known in the art.

XIII Purification of Naturally Occurring Protein Using Specific Antibodies

Naturally occurring or recombinant protein is substantially purified by immunoaffinity chromatography using antibodies specific for the protein. An immunoaffinity column is constructed by covalently coupling the antibody to CNBr-activated SEPHAROSE resin (APB). Media containing the protein is passed over the immunoaffinity column, and the column is washed using high ionic strength buffers in the presence of detergent to allow preferential absorbance of the protein. After coupling, the protein is eluted from the column using a buffer of pH 2–3 or a high concentration of urea or thiocyanate ion to disrupt antibody/protein binding, and the protein is collected.

XIV Screening Molecules for Specific Binding with the cDNA or Protein

The cDNA or fragments thereof and the protein or portions thereof are labeled with $^{32}$P-dCTP, Cy3-dCTP, Cy5-dCTP (APB), or BIODIPY or FITC (Molecular Probes), respectively. Candidate molecules or compounds previously arranged on a substrate are incubated in the presence of labeled nucleic or amino acid. After incubation under conditions for either a cDNA or a protein, the substrate is washed, and any position on the substrate retaining label, which indicates specific binding or complex formation, is assayed. The binding molecule is identified by its arrayed position on the substrate. Data obtained using different concentrations of the nucleic acid or protein are used to calculate affinity between the labeled nucleic acid or protein and the bound molecule. High throughput screening using very small assay volumes and very small amounts of test compound is fully described in Burbaum et al. U.S. Pat. No. 5,876,946.

All patents and publications mentioned in the specification are incorporated herein by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention that are obvious to those skilled in the field of molecular biology or related fields are intended to be within the scope of the following claims.

TABLE 1

| SEQ ID NO | Template ID | GenBank ID | E-Value | Annotation |
|---|---|---|---|---|
| 1 | 230040.1 | g1032587 | 0 | Human CpG island DNA genomic Mse1 fragment, clone 25g3, forward read |
| 2 | 175138.1 | | | |
| 3 | 1863336CB1 | g177109 | 0 | Human leucine-rich protein mRNA, complete |
| 4 | 1863336CD1 | g177109 | 0 | Human leucine-rich protein mRNA, complete |
| 5 | 343861.16 | g5262661 | 0 | Human mRNA; cDNA DKFZp434O071 (from clone DKFZp434O071). |
| 6 | 3170236CB1 | g6318544 | 0 | retinal short-chain dehydrogenase/reductase retSDR2 |
| 7 | 3170236CD1 | g6318544 | 0 | retinal short-chain dehydrogenase/reductase retSDR2 |
| 8 | 259805.54 | g6979641 | 0 | Human alpha gene sequence. |
| 9 | 1460258CB1 | g1658462 | 0 | Human isopeptidase T-3 (ISOT-3) mRNA, complete cds. |
| 10 | 1460258CD1 | g1658462 | 0 | Human isopeptidase T-3 (ISOT-3) mRNA, complete cds. |
| 11 | 1016903.1 | g179501 | 0 | Human bone morphogenetic protein 2A (BMP-2A) mRNA. |
| 12 | 65385.7 | g1694632 | 2.00E-70 | Human mRNA for nonhepatic arginase, complete cds. |
| 13 | 3714.1 | g220051 | 0 | Human RCC1 gene, exons 1, 2, 3, 4, 5, 6, 7, 8, 9, 10, 11, 12, 13, 14, complete cds. |
| 14 | 1720920CB1 | g1617313 | 0 | Human mRNA for melanoma-associated chondroitin sulfate proteoglycan (MCSP). |
| 15 | 1720920CD1 | g1617313 | 0 | Human mRNA for melanoma-associated chondroitin sulfate proteoglycan (MCSP). |
| 16 | 256009.48 | g178280 | 0 | Human AHNAK nucleoprotein mRNA, 5' end. |
| 17 | 1055233.1 | | | |
| 18 | 2114865CB1 | g177808 | 0 | Human alpha-1-antichymotrypsin (AACT) mRNA, complete cds. |
| 19 | 2114865CD1 | g177808 | 0 | Human alpha-1-antichymotrypsin (AACT) mRNA, complete cds. |
| 20 | 1383740.1 | g3342399 | 1.00E-08 | Human mineralocorticoid receptor (MLR), |
| 21 | 2700132CB1 | g415818 | 0 | Human mki67a mRNA (long type) for antigen of monoclonal antibody Ki-67. |
| 22 | 2700132CD1 | g415818 | 0 | Human mki67a mRNA (long type) for antigen of monoclonal antibody KI-67. |
| 23 | 231621.1 | | | |
| 24 | 216485.1 | | | |
| 25 | 406004.2 | g1296799 | 8.00E-16 | Human TPR gene (1365bp). |
| 26 | 1399930.1 | g7768702 | 8.00E-10 | Human genomic DNA, chromosome 21q, section 36/105. |
| 27 | 414171.33 | g5689564 | 0 | Human mRNA for KIAA1114 protein, |
| 28 | 230895.1 | g5630076 | 0 | N-acetylgalactosaminyltransferase; similar to Q10473 (PID:g1709559) |
| 29 | 22827.1 | g7302960 | 4.00E-45 | fidipidine gene product |
| 30 | 346663.6 | g4582689 | 3.00E-94 | connexin 57 |
| 31 | 96422.1 | | | |
| 32 | 405833.1 | | | |
| 33 | 995839.2 | g37120 | 0 | Human mRNA for metallothionein from cadmium-treated cells. |
| 34 | 2517374CB1 | g24444 | 0 | Human mRNA for alpha1-acid glycoprotein (orosomucoid). |
| 35 | 2517374CD1 | g24444 | 0 | Human mRNA for alpha1-acid glycoprotein (orosomucoid). |
| 36 | 1255456CB1 | g30371 | 0 | Human mRNA for cysteine protease inhibitor precursor cystatin C. |
| 37 | 1255456CD1 | g30371 | 0 | Human mRNA for cysteine protease inhibitor precursor cystatin C. |
| 38 | 3084.1 | g1212991 | 2.00E-41 | Human mRNA for titin protein (clone hh1- |
| 39 | 302123.12 | g7243188 | 5.00E-50 | Human mRNA for KIAA1404 protein, partial |
| 40 | 533825CB1 | g3041881 | 0 | LNXp70 |
| 41 | 533825CD1 | g3041881 | 0 | LNXp70 |
| 42 | 220845.2 | g190029 | 4.00E-83 | Human L-plastin polypeptide mRNA, complete cds, clone p107. |
| 43 | 985475.8 | g2982672 | 0 | Human mRNA for p27, complete cds. |
| 44 | 198309.7 | g7023447 | 0 | Human cDNA FLJ11034 fis, clone |
| 45 | 1382869.18 | g337452 | 0 | Human hnRNP B1 protein mRNA. |
| 46 | 1382869.1 | g337452 | 0 | Human hnRNP B1 protein mRNA. |
| 47 | 352049.1 | g671734 | 3.00E-84 | Human DNA, pseudoautosomal boundary-like sequence PABL2. |
| 48 | 215990.2 | g1420919 | 0 | Human fetal brain oculocerebrorenal syndrome (OCRL1) mRNA, complete cds. |
| 49 | 428335.59 | g339646 | 0 | Human thyroid hormone binding protein (p55) mRNA, complete cds. |
| 50 | 1561192CB1 | g1107697 | 0 | Human mRNA for GAIP protein. |
| 51 | 1561192CD1 | g1107697 | 0 | Human mRNA for GAIP protein. |

TABLE 1-continued

| SEQ ID NO | Template ID | GenBank ID | E-Value | Annotation |
|---|---|---|---|---|
| 52 | 1330151.46 | g28596 | 0 | Human fibroblast mRNA for aldolase A. |
| 53 | 1330151.49 | g178350 | 0 | Human aldolase A mRNA, complete cds. |
| 54 | 404028.1 | | | |
| 55 | 996427.2 | g179892 | 0 | Human cAMP phosphodiesterase PDE7 (PDE7A1) mRNA, complete cds. |
| 56 | 21971.1 | g1302657 | 1.00E-13 | Human Xq28 genomic DNA In the region of the L1CAM locus containing the genes for neural cell adhesion molecule L1 (L1CAM), arginine-vasopressin receptor (AVPR2), C1 p115 (C1), ARD1 N-acetyltransferase related protein (TE2), renin-binding protein (RbP), ho |
| 57 | 215205.1 | | | |
| 58 | 400650.3 | | | |
| 59 | 344524.1 | g4769007 | 0 | Human ring finger protein BAP-1 mRNA, complete cds. |
| 60 | 196709.1 | | | |
| 61 | 37502.4 | g3419877 | 0 | Human mRNA for MDC3, complete cds. |
| 62 | 235687.5 | g7020304 | 0 | Human cDNA FLJ20301 fis, clone HEP06569. |
| 63 | 085596CB1 | g184391 | 0 | Human histidine-rich glycoprotein mRNA, complete cds. |
| 64 | 085596CD1 | g184391 | 0 | Human histidine-rich glycoprotein mRNA, complete cds. |
| 65 | 234811.3 | g2330874 | 1.00E-12 | hypothetical protein |
| 66 | 3393396CB1 | g29471 | 0 | Human mRNA for B-myb gene. |
| 67 | 3393396CD1 | g29471 | 0 | Human mRNA for B-myb gene. |
| 68 | 978439.4 | g4500094 | 0 | Human mRNA; cDNA DKFZp564D156 (from clone DKFZp564D156). |
| 69 | 11390.1 | | | |
| 70 | 1382924.42 | g388031 | 0 | Human ribosomal protein L11 mRNA, complete cds. |
| 71 | 1256895CB1 | g2618612 | 0 | Human mRNA for prion protein, complete |
| 72 | 1256895CD1 | g2618612 | 0 | Human mRNA for prion protein, complete |
| 73 | 11115.1 | | | |
| 74 | 291267.1 | g6900101 | 0 | Human mRNA for myeloid DAP12-associating lectin (MDL-1 gene). |
| 75 | 3125723CB1 | g2645430 | 0 | Human CHD2 mRNA, complete cds. |
| 76 | 3125723CD1 | g2645430 | 0 | Human CHD2 mRNA, complete cds. |
| 77 | 980593.1 | g1663705 | 0 | Human mRNA for KIAA0244 gene. partial cds. |
| 78 | 980593.6 | g1663705 | 0 | Human mRNA for KIAA0244 gene. partial cds. |
| 79 | 410739.1 | g7020036 | 8.00E-26 | Human cDNA FLJ20135 fis, clone COL06818. |
| 80 | 405773.2 | g6850949 | 1.00E-41 | dJ202121.4 (novel protein similar to dynein beta heavy chain) |
| 81 | 210871.1 | | | |
| 82 | 20265.2 | | | |
| 83 | 39840.1 | | | |
| 84 | 088564CB1 | g1778716 | 0 | Human chemokine exodus-1 mRNA, |
| 85 | 088564CD1 | g1778716 | 0 | Human chemokine exodus-1 mRNA, |
| 86 | 28889.1 | | | |
| 87 | 410611.1 | g8050709 | 1.00E-11 | Human microsomal epoxide hydrolase (EPHX1) gene, complete cds. |
| 88 | 212533.1 | | | |
| 89 | 24081.12 | g5630079 | 2.00E-29 | similar to zinc finger proteins: similar to AAC01956 (PID:g2843171) |
| 90 | 983961.1 | | | |
| 91 | 1383290.2 | g433415 | 0 | Human mRNA for DNA-binding protein, TAXREB107, complete cds. |
| 92 | 337221.11 | g7020432 | 0 | Human cDNA FLJ20374 fis, clone HUV00348. |
| 93 | 290344.1 | g1353781 | 0 | Human dystrophin-related protein 2 (DRP2) mRNA, complete cds. |
| 94 | 290344.3 | | | |
| 95 | 222714.1 | | | |
| 96 | 2230.1 | | | |
| 97 | 34424.1 | | | |
| 98 | 153237.1 | | | |
| 99 | 272843.14 | g409404 | 0 | Human SREBP-1 mRNA, complete cds. |
| 100 | 234729.3 | g6731234 | 0 | Human myoferlin (MYOF) mRNA, complete |
| 101 | 349647.1 | g8272454 | 6.00E-09 | Human genomic DNA, clone:#7. |
| 102 | 236457.1 | | | |
| 103 | 230193.1 | | | |
| 104 | 213429.1 | | | |
| 105 | 5124.22 | | | |
| 106 | 88974.2 | g7291566 | 0.001 | CG3493 gene product |
| 107 | 903909.1 | g2443342 | 2.00E-07 | alpha 2 type I collagen |
| 108 | 196981.1 | | | |
| 109 | 337888.3 | g4240565 | 0 | Human BAC526N18 neurexin III gene, partial |
| 110 | 795.1 | g6649102 | 2.00E-10 | Human gonadotropin-regulated testicular |

TABLE 1-continued

| SEQ ID NO | Template ID | GenBank ID | E-Value | Annotation |
|---|---|---|---|---|
| 111 | | | | RNA helicase mRNA, complete cds. |
| | 3070147CB1 | g6330145 | 0 | Human mRNA for KIAA1159 protein, partial |
| 112 | 3070147CD1 | g6330145 | 0 | Human mRNA for KIAA1159 protein, partial |
| 113 | 20525.1 | | | |
| 114 | 1382924.38 | g6102909 | 0 | Human mRNA: cDNA DKFZp434M1115 (from clone DKFZp434M1115); partial cds. |
| 115 | 4349106CB1 | g5353532 | 0 | Human zinc finger transcription factor GKLF mRNA, complete cds. |
| 116 | 4349106CD1 | g5353532 | 0 | Human zinc finger transcription factor GKLF mRNA, complete cds. |
| 117 | 247185.1 | g3483187 | 0 | Human full length insert cDNA clone |
| 118 | 197587.3 | g1563884 | 0 | Human fibroblast growth factor homologous factor 1 (FHF-1) mRNA, complete cds. |
| 119 | 403872.1 | g7020302 | 0 | Human cDNA FLJ20300 fis, clone HEP06465. |
| 120 | 900993.1 | | | |
| 121 | 228511.1 | g3874171 | 5.00E-29 | weak similarity to microtubule associated proteins-cDNA EST EMBL:T01154 comes from this gene-cDNA EST EMBL:T02016 comes from this gene-cDNA EST EMBL:D34307 comes from this gene-cDNA EST EMBL:D37339 comes from this gene-cDNA EST |
| 122 | 406975.2 | g7768723 | 1.00E-29 | Human genomic DNA, chromosome 21q, section 70/105. |
| 123 | 200171.17 | | | |
| 124 | 291155.1 | | | |
| 125 | 1383047.1 | g7768705 | 0 | Human genomic DNA, chromosome 21q, section 41/105. |
| 126 | 3230770CB1 | g187460 | 0 | Human mineralocorticoid receptor mRNA (hMR), complete cds. |
| 127 | 3230770CD1 | g187460 | 0 | Human mineralocorticoid receptor mRNA (hMR), complete cds. |
| 128 | 481453.1 | g6143592 | 0 | Human AP-2 gene for transcription factor AP- |
| 129 | 216141.1 | | | |
| 130 | 158318.1 | | | |
| 131 | 408751.3 | g3878837 | 0 | Similarity to Rat TOAD_64 protein (PIR Acc. No. S49985) |
| 132 | 998310.1 | g3243117 | 8.00E-89 | Human cyclin-dependent kinase inhibitor (CDKN2C) mRNA, complete cds. |
| 133 | 1097471.1 | | | |
| 134 | 983843.2 | | | |
| 135 | 983843.1 | | | |
| 136 | 985607.8 | g6382019 | 0 | Human mRNA for KIAA1204 protein, partial |
| 137 | 152298.2 | | | |
| 138 | 246336.2 | g1552548 | 0 | Human mRNA for rab geranylgeranyl transferase, beta-subunit. |
| 139 | 246336.18 | g1552548 | 0 | Human mRNA for rab geranylgeranyl transferase, beta-subunit. |
| 140 | 405126.1 | | | |
| 141 | 253855.2 | g3158350 | 0 | Human acyl-CoA synthetase 4 (ACS4) mRNA, complete cds. |
| 142 | 337187.1 | | | |
| 143 | 932244CB1 | g180065 | 0 | Human thymocyte antigen CD1c mRNA, complete cds. |
| 144 | 932244CD1 | g180065 | 0 | Human thymocyte antigen CD1c mRNA, complete cds. |
| 145 | 160952.1 | | | |
| 146 | 13343.1 | | | |
| 147 | 399488.4 | g7208437 | 0 | Human long-chain 2-hydroxy acid oxidase HAOX2 (HAOX2) mRNA, complete cds. |
| 148 | 399488.5 | | | |
| 149 | 28048.1 | g1432163 | 2.00E-72 | Human LIM-kinase1 and alternatively spliced LIM-kinase1 (LIMK1) gene, complete cds. |
| 150 | 237622.11 | g7023263 | 0 | Human cDNA FLJ10917 fis, clone OVARC1000321. |
| 151 | 237622.6 | g7023263 | 0 | Human cDNA FLJ10917 fis, clone OVARC1000321. |
| 152 | 26612.1 | | | |
| 153 | 413806.9 | g703109 | 0 | Human thyroid receptor interactor (TRIP3) mRNA, 3' end of cds. |
| 154 | 162569.1 | | | |
| 155 | 334116.1 | g1504011 | 0 | Human mRNA for KIAA0215 gene, complete |
| 156 | 396837.1 | | | |
| 157 | 406507.1 | | | |
| 158 | 407612.1 | g506335 | 0 | Human gene for histamine H1-receptor, complete cds. |
| 159 | 399501.1 | g6013005 | 8.00E-86 | Human mRNA for Rab5 GDP/GTP exchange factor homologue (Rabex5 gene). |

TABLE 1-continued

| SEQ ID NO | Template ID | GenBank ID | E-Value | Annotation |
|---|---|---|---|---|
| 160 | 1004517CB1 | g189980 | 0 | Human cAMP-dependent protein kinase subunit RII-beta mRNA, complete cds. |
| 161 | 1004517CD1 | g189980 | 0 | Human cAMP-dependent protein kinase subunit RII-beta mRNA, complete cds. |
| 162 | 199601.12 | g189359 | 0 | Human oncostatin M gene, exon 3. |
| 163 | 232946.1 | g4958922 | 2.00E-73 | NADPH oxidoreductase homolog |
| 164 | 988491CB1 | g7959898 | 0 | Human PRO2386 mRNA, partial cds. |
| 165 | 988491CD1 | g7959898 | 0 | Human PRO2386 mRNA, partial cds. |
| 166 | 199882.12 | | | |
| 167 | 1674368CB1 | g188675 | 0 | Human mannose receptor mRNA, complete |
| 168 | 1674368CD1 | g188675 | 0 | Human mannose receptor mRNA, complete |
| 169 | 115268.8 | g7020748 | 3.00E-91 | Human cDNA FLJ20559 fis, clone KAT11917. |
| 170 | 464689.54 | g30257 | 0 | Human CST3 gene for cystatin C. |
| 171 | 222181.1 | g1144296 | 0 | Human orphan opioid receptor mRNA, complete cds. |
| 172 | 2951538CB1 | g2668504 | 0 | Human putative cyclin G1 interacting protein mRNA, complete cds. |
| 173 | 2951538CD1 | g2668504 | 0 | Human putative cyclin G1 interacting protein mRNA, complete cds. |
| 174 | 1087445.1 | | | |
| 175 | 1079625.3 | g32070 | 0 | Human HF.10 gene mRNA. |
| 176 | 1275616CB1 | g190235 | 0 | Human acidic ribosomal phosphoprotein P2 mRNA, complete cds. |
| 177 | 1275616CD1 | g190235 | 0 | Human acidic ribosomal phosphoprotein P2 mRNA, complete cds. |
| 178 | 228046.5 | g3413917 | 0 | Human mRNA for KIAA0478 protein, |
| 179 | 1225513.1 | g435674 | 0 | Human MT-1l mRNA. |
| 180 | 203438.2 | g174924 | 2.00E-31 | Human initiator Met-tRNA-i. |
| 181 | 232849.13 | g4589524 | 0 | KIAA0940 protein |
| 182 | 19598.1 | | | |
| 183 | 411148.3 | g3021408 | 0 | Human mRNA for transducin (beta) like 1 |
| 184 | 444619.13 | g188712 | 0 | Human (clone 14VS) metallothionein-IG (MT1G) gene, complete cds. |
| 185 | 1383714.1 | | | |
| 186 | 1273641CB1 | g861347 | 3.00E-09 | C18A3.4 gene product |
| 187 | 1273641CD1 | g861347 | 3.00E-09 | C18A3.4 gene product |
| 188 | 403717.1 | | | |
| 189 | 332165.8 | | | |
| 190 | 1098877.1 | g7959918 | 0 | Human PRO2640 mRNA, complete cds. |
| 191 | 251867.2 | g4100453 | 0 | Human ER71 mRNA, partial cds. |
| 192 | 5597.1 | | | |
| 193 | 235356.1 | g5531902 | 1.00E-06 | sodium-dicarboxylate cotransporter |
| 194 | 47593.1 | | | |
| 195 | 995887.12 | g1679673 | 0 | Human Meis1-related protein 2 (MRG2), mRNA, partial cds. |
| 196 | 245687.1 | g1000493 | 6.00E-12 | Human DNA for matrix attachment region. |
| 197 | 1571349CB1 | g6526362 | 0 | Human mRNA for hMBF1beta, complete cds. |
| 198 | 1571349CD1 | g6526362 | 0 | Human mRNA for hMBF1beta, complete cds. |
| 199 | 336735.1 | | | |
| 200 | 40322.1 | g36035 | 0 | Human rhoG mRNA for GTPase. |
| 201 | 205542.2 | g3366801 | 0 | Human orphan G-protein-coupled receptor HG38 mRNA, complete cds. |
| 202 | 1867417CB1 | g292829 | 0 | Human DNA topoisomerase II (top2) mRNA, complete cds. |
| 203 | 1867417CD1 | g292829 | 0 | Human DNA topoisomerase II (top2) mRNA, complete cds. |
| 204 | 402521.1 | g1031335 | 0 | Human CpG island DNA genomic Mse1 fragment, clone 153e2, reverse read |
| 205 | 219537.2 | | | |
| 206 | 219537.1 | | | |
| 207 | 1041138.7 | g2738512 | 0 | Human candidate tumor suppressor pp32r1 (PP32R1) gene, complete cds. |
| 208 | 49272.1 | | | |
| 209 | 221433.21 | g3875538 | 1.00E-05 | similar to cuticle collagen |
| 210 | 232386.18 | g3142287 | 0 | Human protein kinase C-binding protein RACK7 mRNA, partial cds. |
| 211 | 2598244CB1 | g3851170 | 0 | Human Ste-20 related kinase SPAK mRNA, complete cds. |
| 212 | 2598244CD1 | g3851170 | 0 | Human Ste-20 related kinase SPAK mRNA, complete cds. |
| 213 | 2173757CB1 | g3882322 | 0 | Human mRNA for KIAA0801 protein, |
| 214 | 2173757CD1 | g3882322 | 0 | Human mRNA for KIAA0801 protein, |
| 215 | 1405844CB1 | g180925 | 0 | Human CO-029. |
| 216 | 1405844CD1 | g180925 | 0 | Human CO-029. |
| 217 | 1143377.5 | g6691162 | 0 | Human endooligopeptidase A mRNA, partial |
| 218 | 235147.1 | g3153208 | 0 | Human calumein (Calu) mRNA, complete |
| 219 | 235147.2 | g3153208 | 0 | Human calumein (Calu) mRNA, complete |

TABLE 1-continued

| SEQ ID NO | Template ID | GenBank ID | E-Value | Annotation |
|---|---|---|---|---|
| 220 | 1099294.6 | g36114 | 0 | Human mRNA for ribosomal protein L26. |
| 221 | 330927.1 | | | |
| 222 | 50695.1 | g7768699 | 2.00E-13 | Human genomic DNA, chromosome 21q, section 31/105. |
| 223 | 241234.1 | g388031 | 0 | Human ribosomal protein L11 mRNA, complete cds. |
| 224 | 282397.77 | g6683696 | 0 | Human mRNA for KIAA0393 protein, partial |
| 225 | 984009.2 | g863023 | 0 | Human high-mobility group phosphoprotein isoform I-C (HMGIC) mRNA, complete cds. |
| 226 | 138709.5 | g6031211 | 0 | Human heat shock protein hsp40 homolog mRNA, complete cds. |
| 227 | 998926.1 | g7296138 | 5.00E-30 | BcDNA:GH12144 gene product |
| 228 | 1448817CB1 | g183117 | 0 | Human insulin-like growth factor binding protein mRNA, complete cds. |
| 229 | 1448817CD1 | g183117 | 0 | Human insulin-like growth factor binding protein mRNA, complete cds. |
| 230 | 332521.1 | g7768716 | 2.00E-10 | Human genomic DNA, chromosome 21q, section 59/105. |
| 231 | 245136.4 | g5001720 | 1.00E-99 | odd-skipped related 1 protein |
| 232 | 237485.3 | g3360498 | 0 | Human clone 24431 mRNA sequence. |
| 233 | 350851.2 | g413863 | 1.00E-25 | Human A3 adenosine receptor mRNA, complete cds. |
| 234 | 403794.3 | | | |
| 235 | 227489.1 | | | |
| 236 | 268110.1 | | | |
| 237 | 268244.1 | | | |
| 238 | 268253.1 | | | |
| 239 | 270049.1 | | | |
| 240 | 997142.1 | g3893154 | 0 | Human mRNA for ankyrin repeat protein, complete cds. |
| 241 | 997080.1 | g4753765 | 0 | Human mRNA for UDP- |
| 242 | 243369.1 | g184021 | 3.00E-22 | hexokinase 1 |
| 243 | 379571.7 | g6634036 | 0 | Human mRNA for KIAA0453 protein, partial |
| 244 | 322303.15 | g31431 | 0 | Human fit mRNA for receptor-related tyrosine kinase. |
| 245 | 232935.2 | g632775 | 0 | N-CAM=145 kda neural cell adhesion molecule (Human, small cell lung cancer cell line OS2-R, mRNA, 2960 nt). |
| 246 | 1445507CB1 | g2406564 | 0 | Human nuclear VCP-like protein NVLp.2 (NVL.2) mRNA, complete cds. |
| 247 | 1445507CD1 | g2406564 | 0 | Human nuclear VCP-like protein NVLp.2 (NVL.2) mRNA, complete cds. |
| 248 | 69812.3 | g309217 | 2.00E-40 | Eps8 |
| 249 | 444648.12 | g187542 | 0 | Human metallothionein (MT)I-F gene, |
| 250 | 25194.1 | g7303944 | 0.0002 | CG8073 gene product |
| 251 | 1518310CB1 | g4481752 | 0 | Human connexin 26 (GJB2) mRNA, complete |
| 252 | 1518310CD1 | g4481752 | 0 | Human connexin 26 (GJB2) mRNA, complete |
| 253 | 241335.1 | | | |
| 254 | 22651.1 | g1088437 | 0 | Human gene for vascular endothelial growth factor receptor, promoter and exon 1. |
| 255 | 25911.1 | g4406612 | 0 | Human clone 25194 mRNA sequence. |
| 256 | 336470.1 | | | |
| 257 | 978673.2 | g7023272 | 0 | Human cDNA FLJ10922 fis, clone OVARC1000420. |
| 258 | 54242.1 | | | |
| 259 | 1823159CB1 | g1378039 | 0 | Human myotubularin (MTM1) mRNA |
| 260 | 1823159CD1 | g1378039 | 0 | Human myotubularin (MTM1) mRNA, |
| 261 | 20602.1 | | | |
| 262 | 1090531.28 | g6997359 | 0 | Human clone L50 polyadenylated HERV LTR sequence and flanking cellular sequence, |
| 263 | 399872.1 | g7023004 | 5.00E-10 | Human cDNA FLJ10770 fis, clone |
| 264 | 229176.4 | g603816 | 0 | Human gene for glucosephosphate isomerase (exon 15, 16, 17 and 18). |
| 265 | 229176.5 | g189237 | 0 | Human neuroleukin mRNA, complete cds. |
| 266 | 124600CB1 | g1203983 | 0 | Human NAD+-dependent 15 hydroxyprostaglandin dehydrogenase |
| 267 | 124600CD1 | g1203983 | 0 | Human NAD+-dependent 15 hydroxyprostaglandin dehydrogenase |
| 268 | 994387.65 | g6808190 | 0 | Human mRNA: cDNA DKFZp434H2218 (from clone DKFZp434H2218). |
| 269 | 201462.7 | g4581462 | 4.00E-90 | Human mRNA for MEMA protein. |
| 270 | 991497.1 | g6807964 | 0 | Human mRNA; cDNA DKFZp434M092 (from clone DKFZp434M092). |
| 271 | 347444.1 | | | |
| 272 | 238660.5 | g6624921 | 0 | Human mRNA for DMBT1 protein 8kb transcript variant 1 (DMBT1/8kb.1). |
| 273 | 404601.11 | g3483442 | 0 | Human full length insert cDNA clone YZ88E05. |

TABLE 1-continued

| SEQ ID NO | Template ID | GenBank ID | E-Value | Annotation |
|---|---|---|---|---|
| 274 | 1329936.3 | g186803 | 0 | Human tumor antigen (L6) mRNA, complete |
| 275 | 370489.47 | g183363 | 0 | Human granulocyte-macrophage colony stimulating factor (GM-CSF) mRNA. |
| 276 | 197185.2 | g1209634 | 0 | Human putative holocytochrome c-type synthetase mRNA, complete cds. |
| 277 | 1822864CB1 | g3647274 | 0 | Human mRNA for matrilin-3. |
| 278 | 1822864CD1 | g3647274 | 0 | Human mRNA for matrilin-3. |
| 279 | 2258794CB1 | g3327213 | 0 | Human mRNA for KIAA0700 protein, partial |
| 280 | 2258794CD1 | g3327213 | 0 | Human mRNA for KIAA0700 protein, partial |
| 281 | 000506CB1 | g2697102 | 0 | Human heterogeneous nuclear ribonucleoprotein R mRNA, complete cds. |
| 282 | 000506CD1 | g2697102 | 0 | Human heterogeneous nuclear ribonucleoprotein R mRNA, complete cds. |
| 283 | 407263.1 | g2565047 | 0 | Human CAGF9 mRNA, partial cds. |
| 284 | 1630551CB1 | g30302 | 0 | Human mRNA for cytochrome c1. |
| 285 | 1630551CD1 | g30302 | 0 | Human mRNA for cytochrome c1. |
| 286 | 2558815CB1 | g1049218 | 0 | Human gamma-aminobutyraldehyde dehydrogenase mRNA, complete cds. |
| 287 | 2558815CD1 | g1049218 | 0 | Human gamma-aminobutyraldehyde dehydrogenase mRNA, complete cds. |
| 288 | 347411.1 | g4835382 | 5.00E-12 | Human DNA, DLEC1 to ORCTL4 gene region, section 1/2 (DLEC1, ORCTL3, ORCTL4 genes, complete cds). |
| 289 | 92230.2 | g871428 | 1.00E-39 | Hox-4.6 |
| 290 | 333989.1 | | | |
| 291 | 333542.1 | g809021 | 2.00E-49 | Human mRNA for DGCR2. |
| 292 | 2426210CB1 | g3702688 | 0 | Human mRNA for carbonyl reductase 3, complete cds. |
| 293 | 2426210CD1 | g3702688 | 0 | Human mRNA for carbonyl reductase 3, complete cds. |
| 294 | 476760.12 | g3169829 | 1.00E-34 | Human epithelial V-like antigen precursor (EVA) mRNA, complete cds. |
| 295 | 064987CB1 | g3327051 | 0 | Human mRNA for KIAA0619 protein, |
| 296 | 064987CD1 | g3327051 | 0 | Human mRNA for KIAA0619 protein, |
| 297 | 8450.1 | | | |
| 298 | 197652.3 | g4156193 | 0 | supported by GENSCAN prediction and spliced EST; similar to Z35641 (PlD:g3874821) and AI059600 (NID:g3333377) |
| 299 | 248203.2 | g7768678 | 0 | Human genomic DNA, chromosome 21q, section 61/105. |
| 300 | 2023351CB1 | g7295793 | 0 | CG17593 gene product |
| 301 | 2023351CD1 | g7295793 | 0 | CG17593 gene product |
| 302 | 228610.1 | g1028003 | 3.00E-30 | Human CpG island DNA genomic Mse1 fragment, clone 13g6, forward read |
| 303 | 92268.1 | g22599 | 1.00E-10 | APG |
| 304 | 16566.1 | | | |
| 305 | 1329120.1 | g7020677 | 1.00E-58 | Human cDNA FLJ20517 fis, clone KAT10235. |
| 306 | 898877.6 | g4559297 | 0 | Human silencing mediator of retinoic acid and thyroid hormone receptor extended isoform (SMRTE) mRNA, complete cds. |
| 307 | 29490.1 | | | |
| 308 | 2619838CB1 | g2280483 | 0 | Human mRNA for KIAA0372 gene, complete |
| 309 | 2619838CD1 | g2280483 | 0 | Human mRNA for KIAA0372 gene, complete |
| 310 | 369213.42 | g306496 | 4.00E-45 | Human antigen CD9 gene, exon 4. |
| 311 | 3557818CB1 | g306777 | 0 | Human guanine nucleotide exchange factor mRNA, complete cds. |
| 312 | 3557818CD1 | g306777 | 0 | Human guanine nucleotide exchange factor mRNA, complete cds. |
| 313 | 001622CB1 | g632971 | 0 | Human clk3 mRNA, complete cds. |
| 314 | 001622CD1 | g632971 | 0 | Human clk3 mRNA, complete cds. |
| 315 | 223407.4 | g7020909 | 0 | Human cDNA FLJ20662 fis, clone KAIA804. |
| 316 | 899334.1 | g4691727 | 0 | Human ARF GTPase-activating protein GIT2 (KIAA0148) mRNA, complete cds. |
| 317 | 237299.13 | g6102929 | 0 | Human mRNA; cDNA DKFZp434M1827 (from clone DKFZp434M1827). |
| 318 | 1149046.1 | g6137021 | 0 | Human mRNA: cDNA DKFZp566E034 (from clone DKFZp566E034); complete cds. |
| 319 | 404011.3 | g3218467 | 3.00E-20 | putative phosphatase |
| 320 | 3768043CB1 | g2231998 | 0 | Human meningioma-expressed antigen 6 (MEA6) mRNA, complete cds. |
| 321 | 3768043CD1 | g2231998 | 0 | Human meningioma-expressed antigen 6 (MEA6) mRNA, complete cds. |
| 322 | 39946.19 | g1916671 | 0 | Human meningioma-expressed antigen 11 (MEA11) mRNA, partial cds. |
| 323 | 1723834CB1 | g434752 | 0 | Human mRNA for KIAA0030 gene, partial cds. |
| 324 | 1723834CD1 | g434752 | 0 | Human mRNA for KIAA0030 gene, partial cds. |
| 325 | 2551987CB1 | g473948 | 0 | Human mRNA for KIAA0116 gene, partial cds. |

TABLE 1-continued

| SEQ ID NO | Template ID | GenBank ID | E-Value | Annotation |
|---|---|---|---|---|
| 326 | 2551987CD1 | g473948 | 0 | Human mRNA for KIAA0116 gene, partial cds. |
| 327 | 232772.13 | g473948 | 0 | Human mRNA for KIAA0116 gene, partial cds. |
| 328 | 407451.3 | g3169292 | 0 | Human anti-Fas-induced apoptosis (TOSO) mRNA, complete cds. |
| 329 | 1382931.2 | g190231 | 0 | Human acidic ribosomal phosphoprotein P0 mRNA, complete cds. |
| 330 | 1382931.39 | g190231 | 0 | Human acidic ribosomal phosphoprotein P0 mRNA, complete cds. |
| 331 | 411059.1 | | | |
| 332 | 474862.8 | g484101 | 4.00E-85 | Human guanine nucleotide regulatory protein (tim1) mRNA, complete cds. |
| 333 | 402366.1 | g7959228 | 0 | Human mRNA for KIAA1484 protein, partial |
| 334 | 401532.3 | g1764161 | 0 | Human canalicular multispecific organic anion transporter (cMOAT) mRNA complete |
| 335 | 401532.2 | g1574997 | 0 | Human canalicular multispecific organic anion transporter (cMOAT), gene, complete |
| 336 | 407896.4 | g3387952 | 0 | Human clone 24527 mRNA sequence. |
| 337 | 982625.1 | g6329972 | 0 | Human mRNA for KIAA1144 protein, partial |
| 338 | 59947.1 | | | |
| 339 | 902471.11 | g1438934 | 0 | Human SH3 domain-containing protein SH3P18 mRNA, complete cds. |
| 340 | 442308.1 | g3955193 | 0 | Human homeodomain protein (Nkx2.2) gene, exon 2 and complete cds. |
| 341 | 193755.1 | g4808463 | 0 | Human NDRF gene for neuroD-related factor, complete cds. |
| 342 | 60957.1 | | | |
| 343 | 5124.23 | | | |
| 344 | 344166.2 | g8347613 | 0 | Human PNGase mRNA, partial cds. |
| 345 | 1129157.1 | g3288916 | 0 | aortic carboxypeptidase-like protein ACLP |
| 346 | 1804734CB1 | g6606075 | 0 | Human aquaporin 8 (AQP8) mRNA, |
| 347 | 1804734CD1 | g6606075 | 0 | Human aquaporin 8 (AQP8) mRNA, |
| 348 | 43646.7 | g338243 | 0 | Human synexin mRNA, complete cds. |
| 349 | 43646.1 | g338245 | 0 | Human synexin mRNA, 3' end. |
| 350 | 4674640CB1 | g7959864 | 0 | Human PRO2032 mRNA, complete cds. |
| 351 | 4674640CD1 | g7959864 | 0 | Human PRO2032 mRNA, complete cds. |
| 352 | 25423.3 | | | |
| 353 | 415378.3 | g3882244 | 0 | Human mRNA for KIAA0762 protein, partial |
| 354 | 25685.3 | | | |
| 355 | 400427.1 | | | |
| 356 | 198008.8 | g2916801 | 0 | Human mRNA for AMP-activated protein kinase beta 2 subunit. |
| 357 | 1825508CB1 | g398710 | 0 | Human mRNA for cystatin D. |
| 358 | 1825508CD1 | g398710 | 0 | Human mRNA for cystatin D. |
| 359 | 236957.9 | g6482371 | 0 | Human ASC mRNA, complete cds. |
| 360 | 980807.1 | | | |
| 361 | 1095192.1 | g36417 | 0 | Human mRNA for brain type 1 sodium channel alpha-subunit (SCN1A). |
| 362 | 167559.1 | | | |
| 363 | 1383286.12 | g34508 | 0 | Human, gene for Membrane cofactor |
| 364 | 40790.1 | | | |
| 365 | 53059.11 | g7259242 | 4.00E-70 | unnamed protein product |
| 366 | 337156.2 | g999212 | 0 | PEPT 2=H+/peptide cotransporter (Human, kidney, mRNA Partial, 2685 nt). |
| 367 | 349630.7 | g414047 | 0 | Human mRNA for variant hepatic nuclear factor 1 (vHNF1). |
| 368 | 2125081CB1 | g531819 | 0 | Human B lymphocyte serine/threonine protein kinase mRNA, complete cds. |
| 369 | 2125081CD1 | g531819 | 0 | Human B lymphocyte serine/threonine protein kinase mRNA complete cds. |
| 370 | 1400574.1 | g498721 | 4.00E-90 | zinc finger protein |
| 371 | 994430.15 | g6807956 | 0 | Human mRNA; cDNA DKFZp434J052 (from clone DKFZp434J052). |
| 372 | 2631218CB1 | g4886440 | 0 | Human mRNA; cDNA DKFZp564O1716 (from clone DKFZp564O1716); complete cds. |
| 373 | 2631218CD1 | g4886440 | 0 | Human mRNA; cDNA DKFZp564O1716 (from clone DKFZp564O1716); complete cds. |
| 374 | 3688791CB1 | g1770525 | 0 | Human mRNA for SRcyp protein. |
| 375 | 3688791CD1 | g1770525 | 0 | Human mRNA for SRcyp protein. |
| 376 | 3283554CB1 | g1173542 | 0 | Human N-sulphoglucosamine sulfohydrolase mRNA, complete cds. |
| 377 | 3283554CD1 | g1173542 | 0 | Human N-sulphoglucosamine sulfohydrolase mRNA, complete cds. |
| 378 | 4960375CB1 | g347313 | 0 | Human hnRNP H mRNA, complete cds. |
| 379 | 4960375CD1 | g347313 | 0 | Human hnRNP H mRNA, complete cds. |
| 380 | 222956.22 | | | |
| 381 | 222956.24 | | | |
| 382 | 973308.1 | g1215670 | 0 | Human alpha-CP1 mRNA, complete cds. |

TABLE 1-continued

| SEQ ID NO | Template ID | GenBank ID | E-Value | Annotation |
|---|---|---|---|---|
| 383 | 238026.4 | g8164036 | 0 | Human vascular endothelial cadherin 2 mRNA, complete cds. |
| 384 | 1094829.52 | g220087 | 0 | Human mRNA for DNA binding protein |
| 385 | 1094829.54 | g220087 | 0 | Human mRNA for DNA binding protein |
| 386 | 899802.1 | g2463524 | 0 | Human mRNA for CIS4, complete cds. |
| 387 | 107569.15 | g3360439 | 0 | Human clone 23704 mRNA sequence. |
| 388 | 236605.2 | g2338034 | 2.00E-06 | putative immediate early protein |
| 389 | 2705321CB1 | g3005697 | 0 | Human clone 23831 aldolase C mRNA, complete cds. |
| 390 | 2705321CD1 | g3005697 | 0 | Human clone 23831 aldolase C mRNA, complete cds. |
| 391 | 383863.2 | g3426297 | 0 | Human HIC protein isoform p40 and HIC protein isoform p32 mRNAs, complete cds. |
| 392 | 903491.4 | g6688221 | 0 | Human mRNA for TESS 2 protein (TESS 2 |
| 393 | 332755.5 | g7243218 | 0 | Human mRNA for KIAA1419 protein, partial |
| 394 | 201694.5 | g7303230 | 1.00E-13 | CG13018 gene product |
| 395 | 65367.1 | | | |
| 396 | 199140.9 | | | |
| 397 | 1088542.9 | g1922290 | 0 | Human gene encoding enoyl-CoA hydratase, exon 8. |
| 398 | 233513.2 | g854065 | 2.00E-23 | U88 |
| 399 | 1330257.53 | g6563245 | 0 | Human matrin 3 mRNA, complete cds. |
| 400 | 3676741CB1 | g3882166 | 0 | Human mRNA for KIAA0723 protein, |
| 401 | 3676741CD1 | g3882166 | 0 | Human mRNA for KIAA0723 protein, |
| 402 | 346636.6 | | | |
| 403 | 1640555CB1 | g1276898 | 0 | Human limbic system-associated membrane protein LAMP mRNA, complete cds. |
| 404 | 1640555CD1 | g1276898 | 0 | Human limbic system-associated membrane protein LAMP mRNA, complete cds. |
| 405 | 199286.3 | g6599264 | 8.00E-05 | hypothetical protein |
| 406 | 199286.2 | g6599264 | 0.0002 | hypothetical protein |
| 407 | 474200.1 | g7022530 | 0 | Human cDNA FLJ10474 fis, clone |
| 408 | 206397.1 | g3719360 | 1.00E-34 | Human CC chemokine gene cluster, complete sequence. |
| 409 | 199584.1 | g7582297 | 0 | Human BM-013 mRNA complete cds. |
| 410 | 401736.1 | | | |
| 411 | 1100773.2 | g6688198 | 0 | Human mRNA for AMP-activated protein kinase gamma2 subunit (AMPK gamma2 |
| 412 | 167854.1 | | | |
| 413 | 1693903CB1 | g7689018 | 0 | Human uncharacterized hypothalamus protein HT010 mRNA, complete cds. |
| 414 | 1693903CD1 | g7689018 | 0 | Human uncharacterized hypothalamus protein HT010 mRNA, complete cds. |
| 415 | 351432.23 | g6672211 | 0 | Human anion exchanger 2 (SLC4A2) gene, exons 17 to 23 and alternatively spliced products, complete cds. |
| 416 | 1252096CB1 | g399757 | 0 | D10S102=FBRNP (Human, fetal brain, mRNA, 3043nt). |
| 417 | 1252096CD1 | g399757 | 0 | D10S102=FBRNP (Human, fetal brain, mRNA, 3043nt). |
| 418 | 2545475CB1 | g7328161 | 0 | Human mRNA; cDNA DKFZp762B2310 (from clone DKFZp762B2310); complete cds. |
| 419 | 2545475CD1 | g7328161 | 0 | Human mRNA; cDNA DKFZp762B2310 (from clone DKFZp762B2310); complete cds. |
| 420 | 1756951CB1 | g7020528 | 0 | Human cDNA FLJ20432 fis, clone KAT03764. |
| 421 | 1756951CD1 | g7020528 | 0 | Human cDNA FLJ20432 fis, clone KAT03764. |
| 422 | 220134.6 | g1546096 | 0 | Human hbc647 mRNA sequence. |
| 423 | 220134.5 | g1546096 | 0 | Human hbc647 mRNA sequence. |
| 424 | 202164.1 | | | |
| 425 | 406846.4 | g5262542 | 0 | Human mRNA: cDNA DKFZp564G0222 (from clone DKFZp564G0222); complete cds. |
| 426 | 2716815CB1 | g6807723 | 0 | Human mRNA; cDNA DKFZp434J1114 (from clone DKFZp434J1114); partial cds. |
| 427 | 2716815CD1 | g6807723 | 0 | Human mRNA; cDNA DKFZp434J1114 (from clone DKFZp434J1114); partial cds. |
| 428 | 222278.1 | g4186183 | 1.00E-60 | unknown |
| 429 | 1273292CB1 | g179103 | 0 | Human mitochondrial aspartate aminotransferase mRNA, complete cds. |
| 430 | 1273292CD1 | g179103 | 0 | Human mitochondrial aspartate aminotransferase mRNA, complete cds. |
| 431 | 67855.1 | g340123 | 4.00E-10 | Human U4 RNA pseudogene U4/8. |
| 432 | 27185.1 | | | |
| 433 | 240057.2 | g105019 | 0 | Human mRNA for mitochondrial capsule selenoprotein. |
| 434 | 17090.1 | g7300213 | 7.00E-05 | CG5225 gene product |
| 435 | 17021.2 | | | |
| 436 | 235682.5 | | | |

TABLE 1-continued

| SEQ ID NO | Template ID | GenBank ID | E-Value | Annotation |
|---|---|---|---|---|
| 437 | 399329.3 | g4589654 | 2.00E-12 | KIAA1005 protein |
| 438 | 68862.1 | | | |
| 439 | 8603.3 | g7321169 | 3.00E-17 | dJ860F19.4 (PUTATIVE novel protein) |
| 440 | 337647.1 | | | |
| 441 | 200268.3 | g5911954 | 0 | Human mRNA; cDNA DKFZp727M111 (from clone DKFZp727M111); partial cds. |
| 442 | 168861CB1 | g2662410 | 0 | Human homeodomain-containing protein F-(HANF) mRNA, complete cds. |
| 443 | 168861CD1 | g2662410 | 0 | Human homeodomain-containing protein (HANF) mRNA, complete cds. |
| 444 | 334738.1 | | | |
| 445 | 410042.1 | g214042 | 6.00E-07 | alpha-1 type II collagen |
| 446 | 2026270CB1 | g190725 | 0 | Human parathyroid hormone-related protein mRNA, complete cds. |
| 447 | 2026270CD1 | g190725 | 0 | Human parathyroid hormone-related protein mRNA, complete cds. |
| 448 | 522433CB1 | g2674084 | 0 | Human macrophage inhibitory cytokine-1 (MIC-1) mRNA, complete cds. |
| 449 | 522433CD1 | g2674084 | 0 | Human macrophage inhibitory cytokine-1 (MIC-1) mRNA, complete cds. |
| 450 | 234987.1 | | | |
| 451 | 1330257.32 | g28338 | 5.00E-94 | Human mRNA for cytoskeletal gamma-actin. |
| 452 | 407023.1 | g5689375 | 2.00E-91 | tudor repeat associator with PCTAIRE 2 |
| 453 | 3117184CB1 | g4050085 | 0 | Human S164 gene, partial cds; PS1 and hypothetical protein genes, complete cds; and S171 gene, partial cds. |
| 454 | 3117184CD1 | g4050085 | 0 | Human S164 gene, partial cds; PS1 and hypothetical protein genes, complete cds; and S171 gene, partial cds. |
| 455 | 3105671CB1 | g4008148 | 0 | Human alpha-fetoprotein (AFP) mRNA, complete cds. |
| 456 | 3105671CD1 | g4008148 | 0 | Human alpha-fetoprotein (AFP) mRNA, complete cds. |
| 457 | 2051966CB1 | g178856 | 0 | Human apolipoprotein H mRNA, complete |
| 458 | 2051966CD1 | g178856 | 0 | Human apolipoprotein H mRNA, complete |
| 459 | 1969731CB1 | g2344811 | 0 | Human mRNA for Drg1 protein. |
| 460 | 1969731CD1 | g2344811 | 0 | Human mRNA for Drg1 protein. |
| 461 | 2171401CB1 | g7021225 | 0 | Human ERO1-like protein (ERO1-L) mRNA, complete cds. |
| 462 | 2171401CD1 | g7021225 | 0 | Human ERO1-like protein (ERO1-L) mRNA, complete cds. |
| 463 | 1326983.14 | g7243144 | 0 | Human mRNA for KIAA1382 protein, partial |
| 464 | 339106.1 | | | |
| 465 | 331666.1 | | | |
| 466 | 1422432CB1 | g36177 | 0 | Human mRNA for calcium-binding protein |
| 467 | 1422432CD1 | g36177 | 0 | Human mRNA for calcium-binding protein |
| 468 | 409895.2 | g36177 | 0 | Human mRNA for calcium-binding protein |
| 469 | 245136.9 | g1480194 | 2.00E-23 | Sob protein |
| 470 | 2600262CB1 | g896282 | 0 | Human methionine adenosyltransferase alpha subunit gene fragment. |
| 471 | 2600262CD1 | g896282 | 0 | Human methionine adenosyltransferase alpha subunit gene fragment. |
| 472 | 70246.1 | | | |
| 473 | 1086183.1 | g4894364 | 8.00E-59 | zinc finger protein 3 |
| 474 | 900070.12 | g6599211 | 0 | Human mRNA: cDNA DKFZp434E1515(from clone DKFZp434E1515). |
| 475 | 231182.1 | g1030904 | 0 | Human CpG island DNA genomic Mse1 fragment, clone 119c10, reverse read |
| 476 | 12417.1 | | | |
| 477 | 237754.1 | | | |
| 478 | 1256053CB1 | g1917006 | 0 | Human Fritz mRNA, complete cds. |
| 479 | 1256053CD1 | g1917006 | 0 | Human Fritz mRNA, complete cds. |
| 480 | 238391.3 | | | |
| 481 | 201945.4 | g6136944 | 0 | Human mRNA for peptide methionine sulfoxide reductase (msrA gene). |
| 482 | 235725.21 | g2772828 | 0 | Human TFAR19 mRNA, complete cds. |
| 483 | 406031.5 | g5006252 | 0 | Human HGC6.4 mRNA, complete cds. |
| 484 | 998941.1 | g6684533 | 0 | Human zinc finger transcription factor TRPS1 mRNA, complete cds. |
| 485 | 243985.1 | g7020286 | 0 | Human cDNA FLJ20291 fis, clone HEP04788. |
| 486 | 481779.1 | g7020539 | 0 | Human cDNA FLJ20438 fis, clone KAT04696, highly similar to HXC9_MOUSE HOMEOBOX PROTEIN HOX-C9. |
| 487 | 982633.1 | | | |
| 488 | 2120743CB1 | | | |
| 489 | 2120743CD1 | | | |
| 490 | 26914.1 | | | |

TABLE 1-continued

| SEQ ID NO | Template ID | GenBank ID | E-Value | Annotation |
|---|---|---|---|---|
| 491 | 199121.14 | g6630617 | 0 | Human mRNA for KIAA0021 protein, partial |
| 492 | 1960207CB1 | g337504 | 0 | Human ribosomal protein S24 mRNA. |
| 493 | 1960207CD1 | g337504 | 0 | Human ribosomal protein S24 mRNA. |
| 494 | 391185.13 | g5823553 | 0 | Human cyclin L ania-6a mRNA, complete |
| 495 | 206866.1 | g1066121 | 0 | Human hepatocyte nuclear factor-3 alpha (HNF-3 alpha) mRNA, complete cds. |
| 496 | 1330257.51 | g28338 | 0 | Human mRNA for cytoskeletal gamma-actin. |
| 497 | 983942.1 | g5734709 | 3.00E-08 | Contains PF \| 100069 Eukaryotic protein kinase domain. |
| 498 | 223416.15 | g1171563 | 0 | Human mRNA for metabotropic glutamate receptor type 3. |
| 499 | 5876.1 | | | |
| 500 | 303545.3 | | | |
| 501 | 331571.1 | | | |
| 502 | 2246292CB1 | g7959306 | 0 | Human mRNA for KIAA1520 protein, partial |
| 503 | 2246292CD1 | g7959306 | 0 | Human mRNA for KIAA1520 protein, partial |
| 504 | 411449.1 | g5295993 | 0 | Human SDHD gene for small subunit of cytochrome b of succinate dehydrogenase, complete cds. |
| 505 | 409853.3 | g4884218 | 0 | Human mRNA; cDNA DKFZp564A072 (from clone DKFZp564A072). |
| 506 | 6301537CB1 | g2224718 | 0 | Human mRNA for KIAA0389 gene, complete |
| 507 | 6301537CD1 | g2224718 | 0 | Human mRNA for KIAA0389 gene, complete |
| 508 | 1398801.9 | g4884131 | 0 | Human mRNA: cDNA DKFZp586F1019 (from clone DKFZp586F1019); partial cds. |
| 509 | 1398801.5 | g4884131 | 0 | Human mRNA:cDNA DKFZp586F1019 (from clone DKFZp586F1019): partial cds. |
| 510 | 14538.1 | | | |
| 511 | 14007.1 | | | |
| 512 | 239996.2 | | | |
| 513 | 238403.2 | g7959188 | 0 | Human mRNA for KIAA1464 protein, partial |
| 514 | 234681.2 | g7416940 | 0 | Human M5-14 mRNA, complete cds. |
| 515 | 228678.1 | | | |
| 516 | 233218.22 | g291921 | 0 | Human complement factor B mRNA, |
| 517 | 233218.18 | g452937 | 0 | Human complement factor B mRNA, |
| 518 | 6320.1 | g34648 | 0 | Human gene for class II invariant gamma-chain (exon 2-8). |
| 519 | 15433.1 | | | |
| 520 | 1600311CB1 | g2708819 | 0 | Human cytochrome oxidase subunit VIIa-H precursor (COX7AH) gene, nuclear gene encoding mitochondrial protein, complete |
| 521 | 1600311CD1 | g2708819 | 0 | Human cytochrome oxidase subunit VIIa-H precursor (COX7AH) gene, nuclear gene encoding mitochondrial protein, complete |
| 522 | 335999.1 | g4218356 | 5.00E-44 | Human chromosome 18 CpG island DNA, genomic Mse1 fragment, clone 18CGI1H14, |
| 523 | 197523.6 | g1480476 | 0 | Human branched chain alpha-ketoacid dehydrogenase E1 beta subunit mRNA, complete cds. |
| 524 | 12833.1 | | | |
| 525 | 1080598.1 | g7019944 | 0 | Human cDNA FLJ20079 fis, clone COL03057. |
| 526 | 2239738CB1 | g5809681 | 0 | Human carboxypeptidase M precursor, mRNA, partial cds. |
| 527 | 2239738CD1 | g5809681 | 0 | Human carboxypeptidase M precursor, mRNA, partial cds. |
| 528 | 87074.1 | | | |
| 529 | 12039.1 | | | |
| 530 | 1730175CB1 | g2078517 | 0 | Human neogenin mRNA, complete cds. |
| 531 | 1730175CD1 | g2078517 | 0 | Human neogenin mRNA, complete cds. |
| 532 | 6825202CB1 | g2997736 | 0 | Human cytochrome P450 mRNA, complete |
| 533 | 6825202CD1 | g2997736 | 0 | Human cytochrome P450 mRNA, complete |
| 534 | 25613.1 | g3483886 | 0 | Human full length insert cDNA clone ZE09G12. |
| 535 | 3027821CB1 | g6457339 | 0 | Human E2IG3 (E2IG3) mRNA, complete cds. |
| 536 | 3027821CD1 | g6457339 | 0 | Human E2IG3 (E2IG3) mRNA, complete cds. |
| 537 | 480736.41 | g6457339 | 0 | Human E2IG3 (E2IG3) mRNA, complete cds. |
| 538 | 236943.1 | | | |
| 539 | 76636.1 | | | |
| 540 | 76644.1 | | | |
| 541 | 76699.1 | | | |
| 542 | 238140.1 | | | |
| 543 | 19080.2 | g4500250 | 0 | Human mRNA; cDNA DKFZp586F0922 (from clone DKFZp586F0922). |
| 544 | 274444.1 | | | |
| 545 | 279625.1 | | | |
| 546 | 1330220.16 | g3287488 | 0 | Human Hsp89-alpha-delta-N mRNA, |
| 547 | 99792.1 | | | |
| 548 | 5147.1 | g2665892 | 2.00E-33 | kidney injury molecule-1 |

TABLE 1-continued

| SEQ ID NO | Template ID | GenBank ID | E-Value | Annotation |
|---|---|---|---|---|
| 549 | 272599.1 | | | |
| 550 | 238396.1 | | | |
| 551 | 23904.1 | g7717259 | 0 | Human chromosome 21 segment HS21C010. |
| 552 | 274712.1 | g7243020 | 0 | Human mRNA for KIAA1320 protein, partial |
| 553 | 979567.11 | g4704323 | 0 | Human mRNA for ATPaseII, complete cds. |
| 554 | 234121.1 | g7022325 | 1.00E-23 | unnamed protein product |
| 555 | 252493.15 | g6453548 | 0 | Human mRNA; cDNA DKFZp434J0828 (from clone DKFZp434J0828). |
| 556 | 899766.1 | | | |
| 557 | 247423.13 | g5689540 | 0 | Human mRNA for KIAA1102 protein, partial |
| 558 | 334234.2 | | | |
| 559 | 205672.1 | | | |
| 560 | 1327024.5 | g2564321 | 0 | Human mRNA for KIAA0287 gene, parnal cds. |
| 561 | 2925789CB1 | g598573 | 3.00E-96 | Human HepG2 3' region cDNA, clone |
| 562 | 2925789CD1 | g598573 | 3.00E-96 | Human HepG2 3' region cDNA, clone |
| 563 | 335613.1 | | | |
| 564 | 207646.1 | | | |
| 565 | 1720847CB1 | g4218425 | 6.00E-11 | Human pex3 gene joined cds, promoter and exon 1). |
| 566 | 1720847CD1 | g4218425 | 6.00E-11 | Human pex3 gene (joined cds, promoter and exon 1). |
| 567 | 2313349CB1 | g1945364 | 0 | Human copper transport protein HAH1 (HAH1) mRNA, complete cds. |
| 568 | 2313349CD1 | g1945364 | 0 | Human copper transport protein HAH1 (HAH1) mRNA, complete cds. |
| 569 | 107939.2 | g4902677 | 0 | Novel Human gene mapping to chomosome 13, similar to rat RhoGAP. |
| 570 | 11540.1 | | | |
| 571 | 78831.1 | | | |
| 572 | 207778.1 | | | |
| 573 | 296811.1 | g7020093 | 0 | Human cDNA FLJ20171 fis, clone COL09761. |
| 574 | 333776.1 | | | |
| 575 | 1859458CB1 | g30292 | 0 | Human mRNA for CTP synthetase (EC 6.3.4.2). |
| 576 | 1859458CB1 | g30292 | 0 | Human mRNA for CTP synthetase (EC 6.3.4.2). |
| 577 | 110960CB1 | g4589543 | 0 | Human mRNA for KIAA0590 protein, partial |
| 578 | 110960CD1 | g4589543 | 0 | Human mRNA for KIAA0950 protein, partial |
| 579 | 238602.2 | g5262473 | 0 | Human mRNA; cDNA DKFZp564J142 (from clone DKFZp564J142). |
| 580 | 363007.1 | | | |
| 581 | 3478236CB1 | g179039 | 0 | Human amphiregulin (AR) mRNA, complete cds, clones lambda-AR1 and lambda-AR2. |
| 582 | 3478236CD1 | g179039 | 0 | Human amphiregulin (AR) mRNA, complete cds, clones lambda-AR1 and lambda-AR2. |
| 583 | 2466714CB1 | g3387950 | 0 | Human clone 24674 mRNA sequence. |
| 584 | 2466714CD1 | g3387950 | 0 | Human clone 24674 mRNA sequence. |
| 585 | 4208.1 | | | |
| 586 | 903475.2 | g7292499 | 0.0001 | CG15021 gene product |
| 587 | 246037.28 | g927070 | 0 | Human thyroid receptor interactor (TRIP7) mRNA, 3' end of cds. |
| 588 | 337183.1 | | | |
| 589 | 2651836CB1 | g7021191 | 0 | Human cDNA FLJ10005 fis, clone HEMBA1000156. |
| 590 | 2651836CD1 | g7021191 | 0 | HumancDNAFLJ10005 fis. clone HEMBA1000156. |
| 591 | 80339.1 | | | |
| 592 | 480968.13 | g4240302 | 0 | Human mRNA for KIAA0907 protein, |
| 593 | 337448.1 | g5912019 | 0 | Human mRNA; cDNA DKFZp434HO735 (from clone DKFZp434H0735); partial cds. |
| 594 | 5360.1 | | | |
| 595 | 998599.8 | g2226003 | 2.00E-38 | Human Tigger1 transposable element, complete consensus sequence. |
| 596 | 332821.13 | g6457581 | 0 | Human epsilon-tubulin mRNA, complete cds. |
| 597 | 344186.9 | g4959227 | 0 | Human regulator of G-protein signaling 7 (RGS7) mRNA, complete cds. |
| 598 | 344186.12 | g4959229 | 0 | Human regulator of G-protein signaling 7b (RGS7) mRNA. parthal cds. |
| 599 | 212489.1 | | | |
| 600 | 80711.1 | | | |
| 601 | 80787.1 | | | |
| 602 | 334352.1 | | | |
| 603 | 208376.1 | | | |
| 604 | 7820.1 | | | |
| 605 | 81447.1 | | | |
| 606 | 81821.1 | | | |
| 607 | 81869.1 | | | |
| 608 | 210011.1 | g7959150 | 0 | Human mRNA for KIAA1446 protein, partial |

TABLE 1-continued

| SEQ ID NO | Template ID | GenBank ID | E-Value | Annotation |
|---|---|---|---|---|
| 609 | 480336.3 | g2088550 | 0 | Human hereditary haemochromatosis region. histone 2A-like protein gene, hereditary haemochromatosis (HLA-H) gene, RoRet gene, and sodium phosphate transporter (NPT3) gene, complete cds. |
| 610 | 1024610.45 | g7294995 | 5.00E-34 | CG4942 gene product |
| 611 | 82013.1 | g7768717 | 8.00E-11 | Human genomic DNA, chromosome 21q, section 60/105. |
| 612 | 212155.1 | g241541 | 0 | cellular retinoic acid-binding protein (Human, skin, mRNA, 735 nt). |
| 613 | 22632.1 | g7144645 | 0 | Human glutaredoxin-2 (GRX2) mRNA, complete cds. |
| 614 | 2789525CB1 | g3005586 | 0 | Human Ser/Arg-related nuclear matrix protein (SRM160) mRNA, complete cds. |
| 615 | 2789525CD1 | g3005586 | 0 | Human Ser/Arg-related nuclear matrix protein (SRM160) mRNA, complete cds. |
| 616 | 1692213CB1 | g5420452 | 0 | Human mRNA for parvulin, complete cds. |
| 617 | 1692213CD1 | g5420452 | 0 | Human mRNA for parvulin, complete cds. |
| 618 | 15393.1 | g7263958 | 4.00E-35 | bA395L14.1 (novel forkhead protein similar to FOXD4 (forkhead box D4, FREAC5)) |
| 619 | 001089CB1 | g36141 | 0 | Human mRNA for ribosomal protein (homologuous to Yeast S24). |
| 620 | 001089CD1 | g36141 | 0 | Human mRNA for ribosomal protein (homologuous to Yeast S24). |
| 621 | 002484CB1 | g1256264 | 0 | Human protein kinase C inhibitor (PKCI-1) mRNA, complete cds. |
| 622 | 002484CD1 | g1256264 | 0 | Human protein kinase C inhibitor (PKCI-1) mRNA, complete cds. |
| 623 | 669671CB1 | g4092057 | 0 | Human proteasome subunit HSPC mRNA, complete cds. |
| 624 | 669671CD1 | g4092057 | 0 | Human proteasome subunit HSPC mRNA, complete cds. |
| 625 | 1344185CB1 | g189273 | 0 | Human neuropeptide Y (NPY) mRNA, complete cds. |
| 626 | 1344185CD1 | g189273 | 0 | Human neuropeptlde Y (NPY) mRNA, complete cds. |
| 627 | 697785CB1 | g187109 | 0 | Human 14 kd lectin mRNA, complete cds. |
| 628 | 697785CD1 | g187109 | 0 | Human 14 kd lectin mRNA, complete cds. |
| 629 | 336435.2 | g30495 | 0 | Human mRNA for dopamine D2 receptor. |
| 630 | 231558.1 | g1032517 | 5.00E-69 | Human CpG island DNA genomic Mse1 fragment, clone 21h9, reverse read |
| 631 | 247784.3 | g6624587 | 0 | dJ570F3.1 (homolog of the rat synaptic ras GTPase-activating protein p135 SynGAP) |
| 632 | 238322.6 | g3005747 | 0 | Human clone 24722 unknown mRNA, partial |
| 633 | 55978.9 | g7023735 | 0 | Human cDNA FLJ1212 fis, clone PLACE1007958, highly similar to Human cAMP-specific phosphodiesterase 8B mRNA. |
| 634 | 55978.4 | g3818571 | 0 | Human cAMP-specific phosphodiesterase 8B (PDE8B) mRNA, partial cds. |
| 635 | 350977.1 | g174931 | 9.00E-18 | Human U5E snRNA sequence. |
| 636 | 238877.11 | g4191326 | 0 | Human ZIS1 mRNA, complete cds. |
| 637 | 238877.8 | g4191326 | 0 | Human ZIS1 mRNA, complete cds. |
| 638 | 997231.15 | g3062805 | 0 | Human hDPM1 mRNA for dolichol-phosphate-mannose synthase, complete cds. |
| 639 | 997231.16 | g3062805 | 0 | Human hDPM1 mRNA for dolichol-phosphate mannose synthase, complete cds. |
| 640 | 346209.3 | g212451 | 0 | nonmuscle myosin heavy chain |
| 641 | 2515666CB1 | g30338 | 0 | Human mRNA for cytochrome P3-450. |
| 642 | 2515666CD1 | g30338 | 0 | Human mRNA for cytochrome P3-450. |
| 643 | 2742913CB1 | g179771 | 0 | Human carbonic anhydrase II mRNA, complete cds. |
| 644 | 2742913CD1 | g179771 | 0 | Human carbonic anhydrase II mRNA, complete cds. |
| 645 | 336615.1 | g2072161 | 0 | Human tubby related protein 1 (TULP1) mRNA, complete cds. |
| 646 | 406830.43 | g7022107 | 1.00E-57 | Human cDNA FLJ10207 fis, clone HEMBA1005475. |
| 647 | 406830.33 | g7022107 | 4.00E-23 | Human cDNA FLJ10207 fis, clone HEMBA1005475. |
| 648 | 84685.1 | | | |
| 649 | 1045907.4 | | | |
| 650 | 1383803.2 | g1031002 | 0 | Human CpG island DNA genomic Mse1 fragment, clone 127a5, reverse read |
| 651 | 85282.1 | | | |
| 652 | 86326.1 | | | |
| 653 | 337470.1 | | | |

TABLE 1-continued

| SEQ ID NO | Template ID | GenBank ID | E-Value | Annotation |
|---|---|---|---|---|
| 654 | 3721108CB1 | g641961 | 0 | Human steroid hormone receptor Ner-I mRNA, complete cds. |
| 655 | 3721108CD1 | g641961 | 0 | Human steroid hormone receptor Ner-I mRNA, complete cds. |
| 656 | 1090929.2 | g7328949 | 0 | Human 20-alpha HSD gene for 20 alph-hydroxysteroid dehydrogenase, complete |
| 657 | 95374.1 | | | |
| 658 | 238639.2 | | | |
| 659 | 33627.28 | g5163088 | 0 | Human P38IP (P38IP) mRNA, complete cds. |
| 660 | 33627.33 | g5163088 | 0 | Human P38IP (P38IP) mRNA, complete cds. |
| 661 | 435361.1 | g7020164 | 0 | Human cDNA FLJ20215 fis, clone COLF2016. |
| 662 | 474552.1 | g1575342 | 0 | Human apolipoprotein AI regulatory protein-1/chicken ovalbumin upstream promoter transcription factor II (TFCOUP2) gene. complete cds. |
| 663 | 2636759CB1 | g6692782 | 6.00E-44 | protein phosphatase |
| 664 | 2636759CD1 | g6692782 | 6.00E-44 | protein phosphatase |
| 665 | 1083665.4 | g887792 | 0 | Human fragile X mental retardation protein 1 homolog FXR1 mRNA, complete cds. |
| 666 | 240518.21 | g6841489 | 6.00E-58 | Human HSPC134 mRNA, complete cds. |
| 667 | 240518.42 | g6841489 | 0 | Human HSPC134 mRNA, complete cds. |
| 668 | 1322.4 | g7023922 | 0 | Human cDNA FLJ11333 fis, clone |
| 669 | 208282.1 | | | |
| 670 | 345272.5 | | | |
| 671 | 345272.2 | g7290850 | 0 | CG1514 gene product |
| 672 | 997613.1 | g36073 | 4.00E-31 | Human gene hY1 encoding a cytoplasmic |
| 673 | 231840.1 | g4808519 | 0 | Human zinc transporter 1 (ZNT1) gene, partial cds. |
| 674 | 13937.3 | g5788108 | 0 | supported by ESTs T61992 (NID:g665235) and W26450 (NID:g1307167) and Genscan |
| 675 | 253783.6 | g7670456 | 8.00E-95 | unnamed protein product |
| 676 | 20828.1w | g472859 | 0 | Human gas1 gene, complete cds. |
| 677 | 222705.14 | | | |
| 678 | 335906.1 | | | |
| 679 | 1325741.2 | g405193 | 0 | Human splicing factor (CC1.4) mRNA, complete cds. |
| 680 | 2703282CB1 | g5712753 | 0 | Human sex comb on midleg-like-1 protein (SCML1) mRNA, complete cds. |
| 681 | 2703282CD1 | g5712753 | 0 | Human sex comb on midleg-like-1 protein (SCML1) mRNA, complete cds. |
| 682 | 118836.2 | g7020691 | 0 | Human cDNA FLJ20525 fis, clone KAT10610. |
| 683 | 3303.2 | g1654324 | 0 | Human chromosome 5 Mad homolog Smad5 mRNA, complete cds. |
| 684 | 92991.1 | | | |
| 685 | 93603.1 | | | |
| 686 | 1383062.7 | g5926699 | 0 | Human genomic DNA, chromosome 6p21.3, HLA Class I region, section 11/20. |
| 687 | 1383062.8 | g5926700 | 0 | Human genomic DNA, chromosome 6p21.3, HLA Class I region, section 12/20. |
| 688 | 1383794.1 | | | |
| 689 | 406289.1 | g5678818 | 0 | Human FRG1 (FRG1) gene, complete cds; 5S ribosomal RNA gene, complete sequence; TUB4q and TIG2 pseudogenes, complete |
| 690 | 175918.15 | g3882250 | 0 | Human mRNA for KIAA0765 protein, partial |
| 691 | 1068290.1 | g6984171 | 0 | Human chromosome 19 zinc finger protein ZNF226 mRNA, complete cds. |
| 692 | 94873.1 | | | |
| 693 | 403616.1 | | | |
| 694 | 95088.1 | | | |
| 695 | 230402.1 | | | |
| 696 | 95172.1 | | | |
| 697 | 250091.1 | g36515 | 2.00E-13 | Human (HeLa) small nuclear U5 A RNA. |
| 698 | 4113161CB1 | g3360429 | 0 | Human clone 23929 mRNA sequence. |
| 699 | 4113161CD1 | g3360429 | 0 | Human clone 23929 mRNA sequence. |
| 700 | 335375.3 | | | |
| 701 | 95395.1 | | | |
| 702 | 229514.1 | | | |
| 703 | 95573.1 | | | |
| 704 | 230463.1 | | | |
| 705 | 95702.1 | | | |
| 706 | 218090.9 | g3387967 | 0 | Human clone 24503 mRNA sequence. |
| 707 | 96126.1 | g1030761 | 5.00E-41 | Human CpG island DNA genomic Mse1 fragment, clone 10e4. forward read |
| 708 | 1508254CB1 | g587201 | 0 | Human HK2 mRNA for hexokinase II. |
| 709 | 1508254CD1 | g587201 | 0 | Human HK2 mRNA for hexokinase II. |
| 710 | 207452CB1 | g2804436 | 4.00E-53 | Similar to mitochondrial carrier protein |
| 711 | 207452CD1 | g2804436 | 4.00E-53 | Similar to mftochondrlal carrier protein |

TABLE 1-continued

| SEQ ID NO | Template ID | GenBank ID | E-Value | Annotation |
|---|---|---|---|---|
| 712 | 290233.1 | g598240 | 5.00E-16 | Human intron-encoded U22 small nucleolar RNA (UHG) gene. |
| 713 | 1096917.11 | g35219 | 0 | Human mRNA for p68 protein. |
| 714 | 208748.4 | g3876099 | 0 | similar to dynein heavy chain~cDNA EST EMBL:D27549 comes from this gene~cDNA EST EMBL:D34859 comes from this gene |
| 715 | 407517.2 | g4589615 | 0 | Human mRNA for KIAA0986 protein, partial |
| 716 | 233997.1 | | | |
| 717 | 237067.1 | g7768665 | 1.00E-90 | Human genomic DNA, chromosome 21q, section 15/105. |
| 718 | 330862.6 | g2459798 | 2.00E-40 | Human CG1 mRNA, complete cds. |
| 719 | 330862.8 | g2459798 | 0 | Human CG1 mRNA, complete cds. |
| 720 | 2124957CB1 | g8218048 | 0 | dJ187J11.2.6 (novel protein similar to S. pombe and S. cerevisiae predicted proteins (partial isoform 6)) |
| 721 | 2124957CD1 | g8218048 | 0 | dJ187J11.2.6 (novel protein similar to S. pombe and S. cerevisiae predicted proteins (partial isoform 6)) |
| 722 | 1098722.6 | g7021926 | 0 | Human cDNA FLJ10083 fis, clone HEMBA1002084. |
| 723 | 1099023.1 | g340102 | 2.00E-17 | Human U2 small nuclear RNA gene, clone |
| 724 | 201395.4 | g2224626 | 0 | Human mRNA for KIAA0343 gene, complete |
| 725 | 4295277CB1 | g437000 | 0 | Human microtubule-associated protein 1B (MAP1B) gene, complete cds. |
| 726 | 4295277CD1 | g437000 | 0 | Human microtubule-associated protein 1B (MAPIB) gene, complete cds. |
| 727 | 98533.1 | g2898163 | 4.00E-52 | Human microtubule-associated protein tau (tau) gene, exon 0. |
| 728 | 983684.1 | | | |
| 729 | 983684.2 | | | |
| 730 | 1837317CB1 | g28335 | 0 | Human ACTB mRNA for mutant beta-actin (beta'-actin). |
| 731 | 1837317CD1 | g28335 | 0 | Human ACTB mRNA for mutant beta-actin (beta'-actin). |
| 732 | 2937262CB1 | g7020244 | 0 | Human cDNA FLJ20267 fis, clone HEP00925, highly similar to AL049996 Human mRNA; cDNA DKFZp564K112. |
| 733 | 2937262CD1 | g7020244 | 0 | Human cDNA FLJ20267 fis, clone HEP00925, highly similar to AL049996 Human mRNA; cDNA DKFZp564K112. |
| 734 | 199290.9 | g3043595 | 0 | Human mRNA for KIAA0536 protein, partial |
| 735 | 3151579CB1 | g2662348 | 0 | Human mRNA for GCP170, complete cds. |
| 736 | 3151579CD1 | g2662348 | 0 | Human mRNA for GCP170, complete cds. |
| 737 | 235056.14 | g2599359 | 0 | Human RNA hellcase p68 (HUMP68) gene, complete cds. |
| 738 | 337939.2 | g2252495 | 3.00E-58 | Human mRNA for SKAP55 protein. |
| 739 | 208379.1 | | | |
| 740 | 251631.6 | g2088550 | 0 | Human hereditary haemochromatosis region, histone 2A-like protein gene, hereditary haemochromatosis (HLA-H) gene, RoRet gene, and sodium phosphate transporter (NPT3) gene, complete cds. |
| 741 | 2847188CB1 | g29933 | 0 | Human mRNA fragment for second calcitonin gene related peptide (CGRP) from medullary thyroid carcinoma (MTC). |
| 742 | 2847188CD1 | g29933 | 0 | Human mRNA fragment for second calcitonin gene related peptide (CGRP) from medullary thyroid carcinoma (MTC). |
| 743 | 100579.1 | | | |
| 744 | 1327498.1 | g32029 | 0 | Human hB23 gene for B23 nucleophosmin. |
| 745 | 1330212.14 | g186799 | 0 | Human ribosomal protein L12mRNA. complete cds. |
| 746 | 252471.7 | g2465728 | 0 | Human apoptosis-related protein TFAR15 (TFAR 15) mRNA, complete cds. |
| 747 | 252471.4 | g2465728 | 0 | Human apoptosis-related protein TFAR15 (TFAR15) mRNA, complete cds. |
| 748 | 983536.1 | | | |
| 749 | 983536.2 | | | |
| 750 | 1330122.1 | g2739093 | 0 | Human sodium/myo-inositol cotransporter (SLC5A3) gene, complete cds. |
| 751 | 407468.1 | | | |
| 752 | 1330149.46 | g5870840 | 0 | Human cyclophilin-related protein mRNA, complete cds. |
| 753 | 32476.2 | g5360124 | 0 | Human NY-REN-58 antigen mRNA, complete |
| 754 | 1281694CB1 | g7020931 | 0 | Human cDNA FLJ20678 fis, clone KAIA4163. |
| 755 | 1281694CD1 | g7020931 | 0 | Human cDNA FLJ20678 fis, clone KAIA4163. |

TABLE 1-continued

| SEQ ID NO | Template ID | GenBank ID | E-Value | Annotation |
|---|---|---|---|---|
| 756 | 1719478CB1 | g758109 | 0 | Human mRNA for voltage-activated sodium channel. |
| 757 | 1719478CD1 | g758109 | 0 | Human mRNA for voltage-activated sodium channel. |
| 758 | 230611.1 | g1321847 | 4.00E-28 | Human mRNA for U61 small nuclear RNA. |
| 759 | 236749.1 | g6841361 | 0 | Human HSPC062 mRNA, complete cds. |
| 760 | 407124.2 | g4098993 | 6.00E-07 | polyhomeofic 2 |
| 761 | 104322.1 | | | |
| 762 | 400253.14 | g2826476 | 4.00E-35 | IL-17 receptor |
| 763 | 233595.17 | | | |
| 764 | 978065.5 | g7020358 | 0 | Human cDNA FLJ20333 fis, clone HEP11252. |
| 765 | 403642.1 | g6453435 | 9.00E-90 | Human mRNA; cDNA DKFZp586E041 (from clone DKFZp586E041); partial cds. |
| 766 | 984236.4 | g7022881 | 3.00E-36 | unnamed protein product |
| 767 | 984236.1 | g7022881 | 4.00E-42 | unnamed protein product |
| 768 | 1001589CB1 | g1228034 | 0 | Human mRNA for KIAA0191 gene, partial cds. |
| 769 | 1001589CD1 | g1228034 | 0 | Human mRNA for KIAA0191 gene, partial cds. |
| 770 | 7808.1 | g3893101 | 2.00E-91 | CRAG protein |
| 771 | 403627.38 | g6841567 | 0 | Human HSPC174 mRNA, complete cds. |
| 772 | 106415.1 | | | |
| 773 | 474622.1 | g2116983 | 0 | Human mRNA for N-WASP, complete cds. |
| 774 | 1383009.57 | g6979641 | 0 | Human alpha gene sequence. |
| 775 | 1383009.67 | g6979641 | 0 | Human alpha gene sequence. |
| 776 | 1086355.2 | g1905925 | 0 | Human excision and cross link repair protein (ERCC4) gene, complete genomic |
| 777 | 1086355.1 | g5262556 | 0 | Human mRNA; cDNA DKFZp569D2231 (from clone DKFZp569D2231); partial cds. |
| 778 | 998330.2 | g5689519 | 2.00E-44 | KIAA1091 protein |
| 779 | 1384716.4 | g531170 | 0 | Human Csa-19 mRNA complete cds. |
| 780 | 2790762CB1 | g4001815 | 9.00E-11 | putative phosphatidylinositol 3-kinase |
| 781 | 2790762CD1 | g4001815 | 9.00E-11 | putative phosphatidylinositol 3-kinase |
| 782 | 399607.1 | g7022092 | 0 | Human cDNA FLJ10197 fis, clone HEMBA1004795, moderately similar to CDC4-LIKE PROTEIN. |
| 783 | 256138.1 | | | |
| 784 | 413348.4 | g36425 | 0 | Human mRNA for selenoprotein P. |
| 785 | 332088.2 | | | |
| 786 | 035282CB1 | g2580553 | 0 | Human dead box, Y isoform (DBY) mRNA, alternative transcript 2, complete cds. |
| 787 | 035282CD1 | g2580553 | 0 | Human dead box, Y isoform (DBY) mRNA, alternative transcript 2, complete cds. |
| 788 | 350667.7 | g2580553 | 0 | Human dead box, Y Isoform (DBY) mRNA, alternative transcript 2, complete cds. |
| 789 | 343913.1 | g190862 | 0 | Human retinoic acid receptor beta gene, |
| 790 | 211622.1 | | | |
| 791 | 110049.1 | g1212991 | 0 | Human mRNA for titin protein (clone hh1- |
| 792 | 1806212CB1 | g7804449 | 0 | Human mRNA for leucyl tRNA synthetase, complete cds. |
| 793 | 1806212CD1 | g7804449 | 0 | Human mRNA for leucyl tRNA synthetase, complete cds. |
| 794 | 4436028CB1 | g307313 | 0 | Human nucleolysin TIAR mRNA, complete |
| 795 | 4436028CD1 | g307313 | 0 | Human nucleolysin TIAR mRNA, complete |
| 796 | 406663.3 | g7768741 | 0 | Human genomic DNA, chromosome 21q, section 90/105. |
| 797 | 405689.1 | | | |
| 798 | 110815.1 | | | |
| 799 | 1385527.4 | g4033734 | 0 | Human spliceosomal protein SAP 155 mRNA, complete cds. |
| 800 | 2570.1 | | | |
| 801 | 1100724.1 | g498151 | 0 | Human mRNA for KIAA0065 gene, partial cds. |
| 802 | 3704760CB1 | g4165090 | 0 | Human NADH-ubiquinone oxidoreductase PDSW subunit mRNA, complete cds. |
| 803 | 3704760CD1 | g4165090 | 0 | Human NADH-ubiquinone oxidoreductase PDSW subunit mRNA, complete cds. |
| 804 | 344017.6 | g7296669 | 2.00E-16 | CG10979 gene product |
| 805 | 344017.3 | | | |
| 806 | 2770104CB1 | g2653862 | 0 | Human leucocyte Ig-like receptor-2 (LIR-2) mRNA, complete cds. |
| 807 | 2770104CD1 | g2653862 | 0 | Human leucocyte Ig-like receptor-2 (LIR-2)-mRNA, complete cds. |
| 808 | 349204.1 | g37556 | 2.00E-12 | Human U4 small nuclear RNA pseudogene |
| 809 | 2641740CB1 | g1857636 | 0 | Human phosphatidylinositol-4-phosphate 5-kinase type II beta mRNA, complete cds. |
| 810 | 2641740CD1 | g1857636 | 0 | Human phosphatidylinositol-4-phosphate 5-kinase type II beta mRNA, complete cds. |
| 811 | 211881.1 | g340088 | 7.00E-15 | Human small nuclear rna pseudogene (clone pu1-1) and flanks. |

TABLE 1-continued

| SEQ ID NO | Template ID | GenBank ID | E-Value | Annotation |
|---|---|---|---|---|
| 812 | 334749.1 | | | |
| 813 | 407838.1 | | | |
| 814 | 170915CB1 | g3747096 | 0 | Human C1q-related factor mRNA, complete |
| 815 | 170915CD1 | g3747096 | 0 | Human C1q-related factor mRNA, complete |
| 816 | 994387.88 | g7684537 | 1.00E-38 | similar to KIAA0855: similar to BAA74878 (PID:g4240199) |
| 817 | 2454013CB1 | g3335133 | 0 | Human unknown mRNA, complete cds. |
| 818 | 2454013CD1 | g3335133 | 0 | Human unknown mRNA, complete cds. |
| 819 | 427967.6 | g2280483 | 1.00E-84 | Human mRNA for KIAA0372 gene, complete |
| 820 | 427967.4 | g2280483 | 0 | Human mRNA for KIAA0372 gene, complete |
| 821 | 257016.1 | | | |
| 822 | 215158.5 | g7295806 | 2.00E-43 | CG12795 gene product |
| 823 | 522.12 | g3523196 | 0 | Human full length insert cDNA clone YX30B07. |
| 824 | 522.1 | g3523196 | 0 | Human full length insert cDNA clone YX30B07. |
| 825 | 113633.1 | | | |
| 826 | 477387.3 | g469478 | 2.00E-06 | SM-20 |
| 827 | 477387.7 | g1036447 | 8.00E-72 | Human CpG island DNA genomic Mse1 fragment, clone 96f6, forward read |
| 828 | 347796.7 | | | |
| 829 | 2656429CB1 | g4894379 | 0 | Human Mago homolog mRNA, complete |
| 830 | 2656429CD1 | g4894379 | 0 | Human Mago homolog mRNA, complete |
| 831 | 3346307CB1 | g7020644 | 0 | Human cDNA FLJ20500 fis, clone KAT09159. |
| 832 | 3346307CD1 | g7020644 | 0 | Human cDNA FLJ20500 fis, clone KAT09159. |
| 833 | 2649071CB1 | g127580 | 0 | Human pre-T-cell receptor alpha-type chain precursor, mRNA, complete cds. |
| 834 | 2649071CD1 | g1127580 | 0 | Human pre-T-cell receptor alpha-type chain precursor, mRNA, complete cds. |
| 835 | 1383086.2 | g37546 | 0 | Human mRNA for U2 snRNP-specific A' |
| 836 | 1850670CB1 | g182606 | 0 | Human factor I (C3b/C4b inactivator) mRNA, complete cds. |
| 837 | 1850670CD1 | g182606 | 0 | Human factor I (C3b/C4b inactivator) mRNA, complete cds. |
| 838 | 1132386.3 | g6708478 | 0 | formin-like protein |
| 839 | 115052.1 | | | |
| 840 | 1330056CB1 | g2114362 | 0 | Human int-6 mRNA, complete cds. |
| 841 | 1330056CD1 | g2114362 | 0 | Human int-6 mRNA, complete cds. |
| 842 | 199788.2 | g38256 | 0 | Simian mRNA for ral protein. |
| 843 | 27881.1 | | | |
| 844 | 234543.1 | g577299 | 2.00E-59 | The ha2022 gene product Is novel. |
| 845 | 231547.2 | g1035915 | 1.00E-30 | Human CpG island DNA genomic Mse1 fragment. clone 86bl 1, reverse read |
| 846 | 399785.1 | | | |
| 847 | 10498.24 | g4240316 | 0 | Human mRNA for KIAA0914 protein, |
| 848 | 399161.1 | g337708 | 2.00E-37 | Human U1 small nuclear RNA gene, clone HSD4, complete cds. |
| 849 | 241467.1 | g2088550 | 3.00E-90 | Human hereditary haemochromatosis region, histone 2A-like protein gene, hereditary hoemochromatosis (HLA-H) gene. RoRet gene, and sodium phosphate transporter (NPT3) gene, complete cds. |
| 850 | 997194.1 | g2950207 | 0 | Human mRNA for hair keratin acidic 3-II. |
| 851 | 17819.1 | | | |
| 852 | 116536.1 | | | |
| 853 | 116549.1 | | | |
| 854 | 17886.1 | | | |
| 855 | 351032.1 | g339574 | 0 | Human Gly-tRNA-GCC gene and pseudogene, complete cds. |
| 856 | 977532.9 | g7023746 | 0 | Human cDNA FLJ11219 fis, clone |
| 857 | 117273.1 | | | |
| 858 | 212438.1 | | | |
| 859 | 212265.7 | | | |
| 860 | 403560.1 | g7020022 | 0 | Human cDNA FLJ20127 fis, clone COL06176. |
| 861 | 1073168.6 | g5689450 | 0 | Human mRNA for KIAA1057 protein, partial |
| 862 | 1073168.8 | g5689450 | 0 | Human mRNA for KIAA1057 protein, partial |
| 863 | 119614.1 | | | |
| 864 | 119625.1 | | | |
| 865 | 119671.1 | | | |
| 866 | 3177.1 | | | |
| 867 | 119974.1 | | | |
| 868 | 120831.1 | g3861482 | 0 | Human chromosome 3, olfactory receptor pseudogene cluster 1, complete sequence, and myosin light chain kinase (MLCK) pseudogene, partial sequence. |
| 869 | 27619.3 | g8515844 | 0 | Human hepatocellular carcinoma-associated gene TD26 mRNA. |
| 870 | 212872.1 | g7243234 | 0 | Human mRNA for KIAA1427 protein, partial |
| 871 | 404952.4 | g7020256 | 0 | Human cDNA FLJ20275 fis, clone HEF02372. |

TABLE 1-continued

| SEQ ID NO | Template ID | GenBank ID | E-Value | Annotation |
|---|---|---|---|---|
| 872 | 404952.1 | g7020256 | 0 | Human cDNA FLJ20275 fis, clone HEP02372. |
| 873 | 125014.1 | | | |
| 874 | 348390.2 | g36502 | 0 | Human mRNA for enteric smooth muscle gamma-actin. |
| 875 | 227222.1 | | | |
| 876 | 337696.1 | g174945 | 5.00E-23 | Human U4c small nuclear RNA (snRNA). |
| 877 | 253550.2 | g184522 | 0 | Human insulin-like growth factor-binding protein-3 gene, complete cds, clone |
| 878 | 1326925.1 | g6466800 | 0 | Human intestinal mucin 3 (MUC3) gene, |
| 879 | 127140.1 | | | |
| 880 | 127204.1 | g184025 | 6.00E-13 | Human 1,4-alpha-glucan branching enzyme (HGBE) mRNA, complete cds. |
| 881 | 330925.1 | | | |
| 882 | 403960.1 | | | |
| 883 | 20152.1 | g7023908 | 4.00E-25 | unnamed protein product (Homo sapiens) |
| 884 | 26200.1 | | | |
| 885 | 399474.1 | g6630993 | 0 | Human early B-cell transcription factor (EBF) mRNA, partial cds. |
| 886 | 981037.1 | g5114274 | 0 | Human MAB21L2 (MAB21L2) gene, complete |
| 887 | 130502.1 | | | |
| 888 | 5202390CB1 | g4240294 | 0 | Human mRNA for KIAA0903 protein, partial |
| 889 | 5202390CD1 | g4240294 | 0 | Human mRNA for KIAA0903 protein, partial |
| 890 | 213447.4 | g7291182 | 6.00E-08 | CG9732 gene product |
| 891 | 250439.1 | g2102633 | 1.00E-20 | Human DNA for GPI-anchored molecule-like protein, complete cds. |
| 892 | 2743049CB1 | g2253155 | 0 | Human mRNA for Ran_GTP binding protein 5. |
| 893 | 2743049CD1 | g2253155 | 0 | Human mRNA for Ran_GTP binding protein 5. |
| 894 | 256026.8 | g2253155 | 0 | Human mRNA for Ran_GTP binding protein 5. |
| 895 | 998930.1 | g854085 | 0 | Human alpha-s1-casein mRNA. |
| 896 | 981149.2 | | | |
| 897 | 335420.1 | g1911580 | 0 | region centromeric to t(12:17) brokepoint: orf1/unknown 43 amino acid transcript . . . orf3/unknown 50 amino acid transcript (Human, testis, acampomelic campomelic dysplasia and sex reversal patient, Genomic, 3 genes, 3414 nt). |
| 898 | 1082203.1 | g498152 | 0 | ha0946 protein is Kruppel-related. |
| 899 | 225420.1 | g6093245 | 0 | Human mRNA; cDNA DKFZp434B0328 (from clone DKFZp434B0328); partial cds. |
| 900 | 236298.4 | g7768692 | 0 | Human genomic DNA, chromosome 21 q, section 20/105. |
| 901 | 236298.2 | | | |
| 902 | 982813.1 | | | |
| 903 | 154771.1 | g7768657 | 0 | Human PTS gene for6-pyruvoyltetrahydropterin synthose, complete |
| 904 | 477054.1 | g541674 | 0 | Human ADH7 mRNA. |
| 905 | 2966.1 | | | |
| 906 | 136212.1 | g2065210 | 1.00E-13 | Pro-Pol-dUTPase polyprotein |
| 907 | 977975.1 | g7021992 | 0 | Human cDNA FLJ10128 fis, clone HEMBA1002997, weakly similar to CENTROMERIC PROTEIN E. |
| 908 | 1505038CB1 | g536897 | 0 | Human follistatin-related protein precursor mRNA, complete cds. |
| 909 | 1505038CD1 | g536897 | 0 | Human follistatin-related protein precursor mRNA complete cds. |
| 910 | 262830CB1 | g180710 | 0 | Human ciliary neurotrophic factor receptor (CNTFR) mRNA, complete cds. |
| 911 | 262830CD1 | g180710 | 0 | Human ciliary neurotrophic factor receptor (CNTFR) mRNA, complete cds. |
| 912 | 3607580CB1 | g747969 | 0 | Human angiotensin II type 2 receptor gene, complete cds. |
| 913 | 3607580CD1 | g747969 | 0 | Human angiotensin II type 2 receptor gene, complete cds. |
| 914 | 137742.1 | | | |
| 915 | 1095839.1 | g4050043 | 0 | Human RAD17 isoform 4 (RAD17) mRNA, complete cds. |
| 916 | 205328.1 | | | |
| 917 | 252649.14 | g7020522 | 0 | Human cDNA FLJ20429 fis, clone KAT03501. |
| 918 | 221762.2 | g4761786 | 0 | Human full length insert cDNA clone YP86E09. |
| 919 | 138205.1 | | | |
| 920 | 331566.1 | g1710195 | 0 | Human clone 23826 mRNA sequence. |
| 921 | 1384719.3 | g3719220 | 0 | Human vascular endothelial growth factor mRNA, complete cds. |
| 922 | 1330137.1 | g177064 | 3.00E-79 | gorilla gorilla beta-2-microglobulin mRNA (GOGOB2M). |
| 923 | 409962.1 | | | |
| 924 | 481118.7 | g7299388 | 2.00E-39 | CG6621 gene product |

TABLE 1-continued

| SEQ ID NO | Template ID | GenBank ID | E-Value | Annotation |
|---|---|---|---|---|
| 925 | 481118.12 | g6434473 | 2.00E-10 | predicted using genefinder; preliminary |
| 926 | 337528.4 | g189300 | 0 | Human neurotrophin-3 (NT-3) gene. |
| 927 | 3687719CB1 | g2829128 | 0 | Human forkhead-related transcription factor FREAC-10 (FKHL18) mRNA, partial cds. |
| 928 | 3687719CD1 | g2829128 | 0 | Human forkhead-related transcription factor FREAC-1 0 (FKHL1 8) mRNA, partial cds. |
| 929 | 332299.1 | | | |
| 930 | 1530186CB1 | g5262490 | 0 | Human mRNA; cDNA DKFZp564D0462 (from clone DKFZp564D0462). |
| 931 | 1530186CD1 | g5262490 | 0 | Human mRNA; cDNA DKFZp564D0462 (from clone DKFZp564D0462). |
| 932 | 251809.1 | g498909 | 1.00E-81 | Human endothelial-monocyte activating polypeptide II mRNA, complete cds. |
| 933 | 334025.5 | | | |
| 934 | 350134.1 | g1032100 | 9.00E-54 | Human CpG island DNA genomic Mse1 fragment. clone 193d10, forward read |
| 935 | 16124.2 | | | |
| 936 | 140468.1 | | | |
| 937 | 3257507CB1 | g178746 | 0 | Human apurinic/apyrimidinic endonuclease (HAP1h) mRNA, complete cds. |
| 938 | 3257507CD1 | g178746 | 0 | Human apurinic/apyrimidinic endonuclease (HAP1h) mRNA, complete cds. |
| 939 | 1400580.1 | g2723316 | 8.00E-86 | Zinc-finger protein |
| 940 | 481154.3 | g7959270 | 0 | Human mRNA for KIAA1505 protein, partial |
| 941 | 346716.17 | g1147782 | 0 | Human myosin-1Xb mRNA, complete cds. |
| 942 | 346716.21 | | | |
| 943 | 1384720.16 | g28338 | 0 | Human mRNA for cytoskeletal gamma-actin. |
| 944 | 1505790CB1 | g1036132 | 1.00E-75 | Human CpG island DNA genomic Mse1 fragment, clone 8d3, forward read |
| 945 | 1505790CD1 | g1036132 | 1.00E-75 | Human CpG island DNA genomic Mse1 fragment, clone 8d3, forward read |
| 946 | 3876162CB1 | g2467376 | 0 | Human mRNA for calmegin, complete cds. |
| 947 | 3876162CD1 | g2467376 | 0 | Human mRNA for calmegin, complete cds. |
| 948 | 40576.1 | | | |
| 949 | 1040190.14 | | | |
| 950 | 1328310.1 | g1834502 | 0 | Human MUC5B gene (partial). |
| 951 | 34297.1 | g7018498 | 3.00E-23 | Human mRNA; cDNA DKFZp564L1878 (from clone DKFZp564L1878); partial cds. |
| 952 | 145549.2 | | | |
| 953 | 42206.1 | | | |
| 954 | 178799.1 | | | |
| 955 | 214767.1 | | | |
| 956 | 94384.1 | | | |
| 957 | 2852561CB1 | g5926733 | 0 | Human mRNA for 4F2 heavy chain, complete |
| 958 | 2852561CD1 | g5926733 | 0 | Human mRNA for 4F2 heavy chain, complete |
| 959 | 337058.1 | | | |
| 960 | 988704.25 | g2435500 | 0 | Human HRS gene, partial cds. |
| 961 | 988704.26 | g1049079 | 0 | Human splicing factor SRp40-1 (SRp40) mRNA, complete cds. |
| 962 | 401906.2 | | | |
| 963 | 154220.1 | | | |
| 964 | 5371205CB1 | g3289972 | 0 | Human DENN mRNA, complete cds. |
| 965 | 5371205CD1 | g3289972 | 0 | Human DENN mRNA, complete cds. |
| 966 | 147026.1 | | | |
| 967 | 410776.1 | g36073 | 2.00E-12 | Human gene hY1 encoding a cytoplasmic |
| 968 | 335121.1 | g5926687 | 3.00E-80 | Human genomic DNA, chromosome 3p21.3, clone:603 to 320, anti-oncogene region, section 3/3. |
| 969 | 147379.1 | | | |
| 970 | 147403.1 | | | |
| 971 | 1041063.1 | g1334853 | 2.00E-05 | BPLF1 reading frame, 1 NXT/S, analogous to VZV RF22 |
| 972 | 1041063.5 | | | |
| 973 | 230912.1 | g8099056 | 0 | Human regulator of G-protein signaling 17 (RGS17) mRNA, complete cds. |
| 974 | 1089708.18 | g2224670 | 0 | Human mRNA for KIAA0365 gene, parnal cds. |
| 975 | 1050390.1 | g498151 | 6.00E-11 | Human mRNA for KIAA0065 gene, parHal cds. |
| 976 | 088957CB1 | g763428 | 0 | Human mRNA clone with similarity to L-glycerol-3-phosphate:NAD oxidoreductase and albumin gene sequences. |
| 977 | 088957CD1 | g763428 | 0 | Human mRNA clone with similarity to L-glycerol-3-phosphate:NAD oxidoreductase and albumin gene sequences. |
| 978 | 220943.21 | g31441 | 0 | Human mRNA for integrin beta 1 subunit. |
| 979 | 28005.14 | g35896 | 0 | Human mRNA for retinol binding protein |
| 980 | 980446.1 | | | |

TABLE 1-continued

| SEQ ID NO | Template ID | GenBank ID | E-Value | Annotation |
|---|---|---|---|---|
| 981 | 198827.1 | g1017792 | 0 | Human substance P beta-PPT-A mRNA, complete cds. |
| 982 | 215112.1 | g4240476 | 0 | Human short chain L-3-hydroxyacyl-CoA dehydrogenase precursor (HADHSC) gene, nuclear gene encoding mitochondrial protein, complete cds. |
| 983 | 977929.1 | g6690339 | 1.00E-83 | hematopoietic zinc finger protein |
| 984 | 281447.2 | | | |
| 985 | 346641.3 | g684935 | 0 | Human actin-like pepfide mRNA, partial cds. |
| 986 | 230793.3 | g5102577 | 0 | Human mRNA full length insert cDNA clone EUROIMAGE 345330. |
| 987 | 431288.1 | g7021910 | 5.00E-19 | Human cDNA FLJ10073 fis, clone HEMBA1001731. |
| 988 | 4215034CB1 | g1663701 | 0 | Human mRNA for KIAA0243 gene, partial cds. |
| 989 | 4215034CD1 | g1663701 | 0 | Human mRNA for KIAA0243 gene, partial cds. |
| 990 | 150627.1 | | | |
| 991 | 121731.1 | | | |
| 992 | 259907.1 | | | |
| 993 | 977727.13 | | | |
| 994 | 5915.1 | g1737211 | 0 | Human basic transcription factor 2 p44 (bff2p44) gene, partial cds, neuronal apoptosis inhibitory protein (naip) and survival motor neuron protein (smn) genes. |
| 995 | 8835.1 | g7768716 | 9.00E-10 | Human genomic DNA, chromosome 21q, section 59/105. |
| 996 | 242010.6 | g5926690 | 0 | Human genomic DNA, chromosome 6p21.3, HLA Class I region. section 2/20. |
| 997 | 242684.1 | g5678818 | 0 | Human FRG1 (FRG1) gene, complete cds; 5S ribosomal RNA gene, complete sequence; TUB4q and TIG2 pseudogenes, complete |
| 998 | 335145.1 | | | |
| 999 | 678004CB1 | g7417394 | 0 | Human peroxisome proliferative activated receptor delta (PPARD) gene, exon 9 and |
| 1000 | 678004CD1 | g7417394 | 0 | Human peroxisome proliferative activated receptor delta (PPARD) gene, exon 9 and |
| 1001 | 92922.1 | g5669134 | 9.00E-67 | Human constitutive fragile region FRA3B sequence. |
| 1002 | 411373.7 | g7243116 | 0 | Human mRNA for KIAA1368 protein, partial |
| 1003 | 404715.1 | | | |
| 1004 | 278831.1 | | | |
| 1005 | 343924.8 | g2887416 | 0 | Human KIAA0421 mRNA, partial cds. |
| 1006 | 200977.1 | g2792363 | 0 | Human unknown protein IT1 mRNA, partial |
| 1007 | 181818.3 | | | |
| 1008 | 029251CB1 | g393314 | 0 | Human HFREP-1 mRNA for unknown protein, complete cds. |
| 1009 | 029251CD1 | g393314 | 0 | Human HFREP-1 mRNA for unknown protein, complete cds. |
| 1010 | 335648.1 | g36712 | 0 | Human mRNA for tyrosine aminotransferase (TAT) (EC 2.6.1.5). |
| 1011 | 331108.1 | g34330 | 0 | Human mRNA for apolipoprotein B-100. |
| 1012 | 333840.1 | g452443 | 0 | Human glucose-6-phosphatase mRNA, complete cds. |
| 1013 | 334298.1 | | | |
| 1014 | 344597.2 | g4589485 | 3.00E-91 | Human mRNA for KIAA0927 protein, partial |
| 1015 | 1262593.2 | g4914599 | 0 | Human mRNA; cDNA DKFZp564A126 (from clone DKFZp564A126): partial cds. |
| 1016 | 461375.2 | | | |
| 1017 | 233660.2 | g7021005 | 0 | Human cDNA FLJ20727 fis, clone HEP13238. |
| 1018 | 230179.3 | g7295706 | 2.00E-75 | CG15438 gene product |
| 1019 | 230179.7 | g7295706 | 9.00E-15 | CG15438 gene product |
| 1020 | 296245.1 | | | |
| 1021 | 981208.1 | g6650767 | 9.00E-11 | Human pancreas-enriched phospholipase C mRNA, complete cds. |
| 1022 | 406580.1 | g1480103 | 5.00E-11 | TYL |
| 1023 | 200051.1 | g3483384 | 0 | Human full length insert cDNA clone |
| 1024 | 1197030.1 | g1800114 | 0 | Human ribosomal protein L7 antisense mRNA gene, partial sequence. |
| 1025 | 1197030.1 | g35902 | 0 | Human mRNA for ribosomal protein L7. |
| 1026 | 158859.1 | | | |
| 1027 | 229490.1 | | | |
| 1028 | 4832672CB1 | g31988 | 0 | Human H3.3 gene exon 4. |
| 1029 | 4832672CD1 | g31988 | 0 | Human H3.3 gene exon 4. |
| 1030 | 339638.1 | | | |
| 1031 | 480885.2 | g2394309 | 0 | Human homeobox protein MEIS2 (MEIS2) mRNA, partial cds. |
| 1032 | 342074.1 | g5732679 | 0 | Human amino acid transporter B0+ (ATB0+) mRNA, complete cds. |

TABLE 1-continued

| SEQ ID NO | Template ID | GenBank ID | E-Value | Annotation |
|---|---|---|---|---|
| 1033 | 406992.1 | g5668544 | 0 | Human mRNA for cystine/glutamate transporter, complete cds. |
| 1034 | 1852849CB1 | g2580571 | 0 | Human ubiquitous TPR motif, X Isoform (UTX) mRNA, alternative transcript 2, complete cds. |
| 1035 | 1852849CD1 | g2580571 | 0 | Human ubiquitous TPR motif, X isoform (UTX) mRNA, alternative transcript 2, complete cds. |
| 1036 | 1132829.1 | g4886454 | 0 | Human mRNA; cDNA DKFZp566G013 (from clone DKFZp566GO13); complete cds. |
| 1037 | 339800.1 | | | |
| 1038 | 1399492.1 | | | |
| 1039 | 13039.2 | g4589583 | 0 | Human mRNA for KIAA0970 protein, |
| 1040 | 399626.1 | | | |
| 1040 | 365070.3 | g3550345 | 4.00E-34 | cellular repressor of E1 A-stimulated genes |
| 1042 | 365070.1 | | | |
| 1043 | 1383263.1 | g37643 | 8.00E-88 | vacuolor proton-ATPase |
| 1044 | 1383263.14 | g1710247 | 0 | Human protein disulfide isomerase-related protein P5 mRNA, partial cds. |
| 1045 | 406707.2 | g7110216 | 3.00E-19 | C-type lectin-like receptor-1 |
| 1046 | 406707.1 | | | |
| 1047 | 1051954.7 | g6984171 | 0 | Human chromosome 19 zinc finger protein ZNF226 mRNA, complete cds. |
| 1048 | 102564.1 | g7274891 | 3.00E-37 | Human chromosome Xq28 psHMG17 pseudogene, complete sequence; and melanoma antigen family A1 (MAGEA1) and zinc finger protein 275 (ZNF275) genes, |
| 1049 | 233312.1 | g4406631 | 1.00E-22 | Human clone 25221 mRNA sequence, complete cds. |
| 1050 | 335568.1 | g1401184 | 0 | Human adhesion molecule DNAM-1 mRNA, complete cds. |
| 1051 | 407739.1 | | | |
| 1052 | 272273.1 | g6483295 | 0 | Human CDH9 mRNA for cadherin-9, |
| 1053 | 399133.9 | g6807782 | 0 | Human mRNA; cDNA DKFZp434P086 (from clone DKFZp434P086); partial cds. |
| 1054 | 246727.11 | g337456 | 0 | Human ribonucleoprotein (La) mRNA, 3' end. |
| 1055 | 246727.17 | g178686 | 0 | Human La protein mRNA, complete cds. |
| 1056 | 230367.2 | | | |
| 1057 | 1383039.18 | g32466 | 0 | Human hsc70 gene for 71 kd heat shock cognate protein. |
| 1058 | 1383039.17 | g7672662 | 0 | Tamarin (Saguinus oedipus) intracellular vitamin D binding protein 1 (IDBP1) mRNA, |
| 1059 | 27704.2 | | | |
| 1060 | 346900.1 | g453469 | 5.00E-18 | Human mRNA for ras-related GTP-binding |
| 1061 | 249813.1 | g5732617 | 0 | Human myosin-1Xa mRNA, complete cds. |
| 1062 | 411357.1 | g189564 | 0 | Human, plasminogen activator inhibitor-1 gene, exons 2 to 9. |
| 1063 | 68902.1 | | | |
| 1064 | 210133.1 | g4186165 | 0 | Human candidate tumor suppressor HIC-1 (HIC-1) gene, complete cds. |
| 1065 | 430665.1 | g1495463 | 0 | Human mRNA for metallothionein isoform 1R. |
| 1066 | 902525.1 | g409069 | 0 | Human mRNA for HBp15/L22, complete cds. |
| 1067 | 256841.1 | g1032232 | 4.00E-50 | Human CpG island DNA genomic Mse1 fragment, clone 1e2, forward read |
| 1068 | 206344.1 | | | |
| 1069 | 107309.1 | | | |
| 1070 | 1074024.1 | | | |
| 1071 | 233218.7 | g2347130 | 0 | Human HLA class III region containing tenascin X (tenascin-X) gene, partial cds; cytochrome P450 21-hydroxylase (CYP21B), complement component C4 (C4B) g11, helicase (SKI2W), RD, complement factor B (Bf), and complement component C2 (C2) |
| 1072 | 1092387.12 | g7328949 | 0 | Human 20-alpha HSD gene for 20 alph-hydroxysterold dehydrogenase, complete |
| 1073 | 1092387.11 | g7328949 | 0 | Human 20-alpha HSD gene for 20 alph-hydroxysteroid dehydrogenase, complete |
| 1074 | 366463.1 | g1710239 | 7.00E-14 | Human clone 23933 mRNA sequence. |
| 1075 | 304409.1 | | | |
| 1076 | 1382920.38 | g31347 | 0 | Human pseudogene for apoferritin H (clone |
| 1077 | 342365.1 | g1228035 | 2.00E-23 | The KIAA0191 gene is expressed ubquitously.; The KIAA0191 protein retains the C2H2 zinc-finger at its N-terminal region. (Homo sapiens) |
| 1078 | 399210.1 | | | |
| 1079 | 1089210.1 | g544761 | 0 | chlordecone reductase {clone HAKRa} (Human, liver, mRNA, 1167 nt). |
| 1080 | 444619.9 | g188712 | 0 | Human (clone 14VS) metallothionein-IG (MT1g) gene, complete cds. |
| 1081 | 312986.1 | | | |

TABLE 1-continued

| SEQ ID NO | Template ID | GenBank ID | E-Value | Annotation |
|---|---|---|---|---|
| 1082 | 462057.1 | g36111 | 0 | Human RNA for ros1. |
| 1083 | 197902.12 | g391735 | 0 | Human mRNA for very low density lipoprotein receptor, complete cds. |
| 1084 | 997394.4 | g3851202 | 0 | ZO-3 |
| 1085 | 2481150CB1 | g4455124 | 0 | Human Sk/Dkk-1 protein precursor, mRNA, complete cds. |
| 1086 | 2481150CD1 | g4455124 | 0 | Human Sk/Dkk-1 protein precursor, mRNA, complete cds. |
| 1087 | 8198.1 | | | |
| 1088 | 72297.2 | | | |
| 1089 | 994430.16 | g8101070 | 7.00E-71 | Human golgin-like protein (GLP) gene, complete cds. |
| 1090 | 189036.1 | | | |
| 1091 | 221042.1 | g7296756 | 1.00E-57 | CG1172geneproduct |
| 1092 | 408398.1 | | | |
| 1093 | 985369.1 | | | |
| 1094 | 328796.1 | | | |
| 1095 | 58804.1 | | | |
| 1096 | 3505463CB1 | g5640003 | 0 | Human ras-related GTP-binding protein 4b (RAB4B) mRNA, complete cds. |
| 1097 | 3505463CD1 | g5640003 | 0 | Human ras-related GTP-binding protein 4b (RAB4B) mRNA, complete cds. |
| 1098 | 197159.1 | g23421 | 5.00E-47 | Human (D1S228) DNA segment containing (CA) repeat; clone AFM196xb4; single read. |
| 1099 | 369928.1 | | | |
| 1100 | 413466.6 | g1806039 | 0 | Human mRNA for adipophilin. |
| 1101 | 397295.1 | g7768668 | 1.00E-15 | Human genomic DNA, chromosome 21q, section 24/105. |
| 1102 | 1330139.5 | g31099 | 0 | Human mRNA for elongation factor-1-beta. |
| 1103 | 977951.1 | g7020272 | 0 | Human cDNA FLJ20283 fis, clone HEP04088. |
| 1104 | 347316.1 | g7414319 | 0 | Human mRNA for type III sodium channel protein (SCN3A gene). |
| 1105 | 150288.3 | | | |
| 1106 | 2455.1 | g2708709 | 2.00E-13 | Wiskott-Aldrich Syndrome protein homolog |
| 1107 | 372647.1 | | | |
| 1108 | 137710.1 | | | |
| 1109 | 407644.1 | g187266 | 1.00E-25 | Human LYL-1 protein gene, complete cds. |
| 1110 | 373516.1 | g5690368 | 6.00E-10 | Rhesus monkey glucose phosphate isomerase (GPI) gene, partial intron |
| 1111 | 241762.23 | g6330377 | 0 | Human mRNA for KIAA1196 protein, partial |
| 1112 | 1040914.1 | g5689484 | 4.00E-12 | Human mRNA for KIAA1074 protein, |
| 1113 | 358492.1 | | | |
| 1114 | 243924.12 | g35570 | 1.00E-53 | polyA binding protein (AA 1-633) |
| 1115 | 243924.13 | g3876085 | 0 | similar to poly-adenylate binding protein~cDNA EST EMBL:T01123 comes from this gene~cDNA EST EMBL:D27926 comes from this gene~cDNA EST EMBL:D27925 comes from this gene~cDNA EST EMBL:T00103 comes from this gene~cDNA EST EMBL:T00104 |
| 1116 | 208075.1 | g23915 | 6.00E-47 | Human 7SK RNA gene and flanking regions. |
| 1117 | 168955.1 | | | |
| 1118 | 428508.1 | | | |
| 1119 | 418070.1 | g7021107 | 0 | Human cDNA FLJ20795 fis, clone COL00329. |
| 1120 | 403994.5 | g6708123 | 4.00E-34 | cone potassium-dependent sodium-calcium exchanger |
| 1121 | 336726.1 | | | |
| 1122 | 337250.1 | g4539520 | 5.00E-38 | dA22D12.1 (novel protein similar to Drosophila Kelch (Ring Canal protein, KEL) and a heterogenous set of other types of proteins) |
| 1123 | 410781.1 | g1563890 | 0 | Human fibroblast growth factor homologous factor 4 (FHF-4) mRNA, complete cds. |
| 1124 | 347759.3 | g28338 | 0 | Human mRNA for cytoskeletal gamma-actin. |
| 1125 | 1252060.4 | g7770216 | 0 | Human PRO2675 mRNA, complete cds. |
| 1126 | 209279.1 | g177808 | 0 | Human alpha-1-antichymotrypsin (AACT) mRNA, complete cds. |
| 1127 | 418391.2 | g7242973 | 2.00E-56 | KIAA1309 protein |
| 1128 | 480630.21 | | | |
| 1129 | 117799.1 | | | |
| 1130 | 235194.15 | g7293114 | 8.00E-11 | CG8198 gene product |
| 1131 | 379400.1 | g1575442 | 6.00E-53 | Human small nuclear RNA U6atac, partial sequence. |
| 1132 | 380433.1 | | | |
| 1133 | 140122.22 | g5106993 | 0 | Human HSPC038 protein mRNA, complete |
| 1134 | 131931.1 | g189059 | 0 | Human Na,K-ATPase beta subunit (ATP1B) gene, exons 3 through 6. |
| 1135 | 381058.1 | g1021027 | 0 | Human CpG island DNA genomic Mse1 fragment, clone 181h1, reverse read |

TABLE 1-continued

| SEQ ID NO | Template ID | GenBank ID | E-Value | Annotation |
|---|---|---|---|---|
| 1136 | 403136.1 | g35896 | 3.00E-25 | Human mRNA for retinol binding protein |
| 1137 | 276647.1 | g4028582 | 2.00E-12 | Human connective tissue growth factor related protein WISP-2 (WISP2) mRNA, |
| 1138 | 191631.1 | g4028582 | 6.00E-13 | Human connective tissue growth factor related protein WISP-2 (WISP2) mRNA, |
| 1139 | 887619.26 | g5817036 | 0 | Human mRNA; cDNA DKFZp564D0164 (from clone DKFZp564D0164). |
| 1140 | 980953.1 | | | |
| 1141 | 389859.1 | | | |
| 1142 | 217281.1 | g5669134 | 2.00E-12 | Homo sapiens consfitutive fragile region FRA3B sequence. |
| 1143 | 32428.1 | | | |

TABLE 2

| SEQ ID NO | Clone ID | Start | Stop | Frame | PFAM Description | E-Value |
|---|---|---|---|---|---|---|
| 4 | 1863336CD1 | 46 | 80 | PEPT | PPR repeat | 1.70E − 04 |
| 7 | 3170236CD1 | 37 | 224 | PEPT | short chain dehydrogenase | 1.50E − 48 |
| 10 | 1460258CD1 | 728 | 767 | PEPT | UBA domain | 2.20E − 16 |
| 10 | 1460258CD1 | 336 | 367 | PEPT | Ubiquitin carboxyl-terminal hydrolases family | 7.80E − 13 |
| 10 | 1460258CD1 | 802 | 860 | PEPT | Ubiquitin carboxyl-terminal hydrolase family 2 | 8.70E − 23 |
| 10 | 1460258CD1 | 211 | 286 | PEPT | Zn-finger in ubiquitin-hydrolases and other proteins | 2.50E − 33 |
| 11 | 1016903.1 | 2050 | 2352 | forward 1 | Transforming growth factor beta like domain | 4.30E − 80 |
| 11 | 1016903.1 | 1270 | 1968 | forward 1 | TGF-beta propeptide | 7.50E − 90 |
| 15 | 1720920CD1 | 55 | 181 | PEPT | Laminin G domain | 2.00E − 25 |
| 19 | 2114865CD1 | 46 | 420 | PEPT | Serpins (serine protease inhibitors) | 1.60E − 216 |
| 22 | 2700132CD1 | 27 | 91 | PEPT | FHA domain | 4.30E − 21 |
| 27 | 414171.33 | 1108 | 1779 | forward 1 | MAGE family | 6.70E − 25 |
| 28 | 230895.1 | 73 | 627 | forward 1 | Glycosyl transferases | 1.00E − 45 |
| 28 | 230895.1 | 994 | 1371 | forward 1 | Similarity to lectin domain of ricin beta-chain, 3 copies. | 1.40E − 38 |
| 30 | 346663.6 | 156 | 704 | forward 3 | Connexin | 1.20E − 50 |
| 30 | 346663.6 | 289 | 828 | forward 1 | Connexin | 1.10E − 11 |
| 33 | 995839.2 | 99 | 248 | forward 3 | Metallothionein | 6.80E − 08 |
| 35 | 2517374CD1 | 38 | 183 | PEPT | Lipocalin / cytosolic fatty-acid binding protein family | 2.10E − 33 |
| 37 | 1255456CD1 | 37 | 142 | PEPT | Cystatin domain | 6.60E − 42 |
| 41 | 533825CD1 | 178 | 262 | PEPT | PDZ domain (Also known as DHR or GLGF). | 9.30E − 15 |
| 45 | 1382869.18 | 504 | 716 | forward 3 | RNA recognition motif. (a.k.a. RRM, RBD, or RNP domain) | 8.90E − 21 |
| 46 | 1382869.1 | 158 | 370 | forward 2 | RNA recognition motif. (a.k.a. RRM, RBD, or RNP domain) | 7.00E − 19 |
| 48 | 215990.2 | 949 | 1854 | forward 1 | Inositol polyphosphate phosphatase family, catalytic domain | 9.80E − 166 |
| 48 | 215990.2 | 2440 | 2862 | forward 1 | RhoGAP domain | 1.00E − 52 |
| 49 | 428335.59 | 977 | 1096 | forward 2 | Thioredoxin | 1.00E − 07 |
| 51 | 1561192CD1 | 90 | 206 | PEPT | Regulator of G protein signaling domain | 5.20E − 56 |
| 52 | 1330151.46 | 284 | 1333 | forward 2 | Fructose-bisphosphate aldolase class-1 | 7.60E − 270 |
| 53 | 1330151.49 | 724 | 1734 | forward 1 | Fructose-bisphosphate aldolase class-1 | 2.30 E − 258 |
| 61 | 37502.4 | 1751 | 1978 | forward 2 | Disintegrin | 9.00E − 17 |
| 61 | 37502.4 | 713 | 1063 | forward 2 | Reprolysin family propeptide | 3.00E − 18 |
| 61 | 37502.4 | 1115 | 1708 | forward 2 | Reprolysin (M12B) family zinc metalloprotease | 2.60E − 90 |
| 64 | 085596CD1 | 17 | 126 | PEPT | Cystatin domain | 3.10E − 25 |
| 67 | 3393396CD1 | 83 | 129 | PEPT | Myb-like DNA-binding domain | 4.80E − 22 |
| 70 | 1382924.42 | 176 | 457 | forward 2 | ribosomal L5P family C-terminus | 5.80E − 45 |
| 72 | 1256895CD1 | 23 | 253 | PEPT | Prion protein | 6.30E − 203 |
| 74 | 291267.1 | 486 | 746 | forward 3 | Lectin C-type domain | 1.30E − 5 |
| 76 | 3125723CD1 | 281 | 327 | PEPT | 'chromo' (CHRromatin Organization MOdifier) domain | 1.80E − 14 |
| 76 | 3125723CD1 | 821 | 905 | PEPT | Helicases conserved C-terminal domain | 1.90E − 24 |
| 76 | 3125723CD1 | 487 | 768 | PEPT | SNF2 and others N-terminal domain | 1.20E − 138 |
| 85 | 088564CD1 | 24 | 89 | PEPT | Small cytokines (intecrine/chemokine), Interleukin-8 like | 2.50E − 10 |
| 89 | 24081.12 | 1250 | 318 | forward 2 | Zinc finger, C2H2 type | 1.60E − 06 |
| 91 | 1383290.2 | 317 | 673 | forward 2 | Ribosomal protein L6e | 4.50E − 10 |
| 91 | 1383290.2 | 247 | 588 | forward 1 | Ribosomal protein L6e | 5.80E − 08 |
| 93 | 290344.1 | 1101 | 1286 | forward 3 | Spectrin repeat | 1.80E − 06 |
| 93 | 290344.1 | 596 | 829 | forward 2 | Spectrin repeat | 2.30E − 04 |
| 93 | 290344.1 | 1335 | 1424 | forward 3 | WW domain | 5.40E − 08 |
| 93 | 290344.1 | 2085 | 2222 | forward 3 | Zinc finger present in dystrophin, CBP/p300 | 1.80E − 10 |
| 99 | 272843.14 | 1212 | 1364 | forward 3 | Helix-loop-helix DNA-binding domain | 4.90E − 10 |
| 100 | 234729.3 | 810 | 1106 | forward 3 | C2 domain | 4.70E − 10 |
| 100 | 234729.3 | 4300 | 4551 | forward 1 | C2 domain | 5.10E − 08 |

TABLE 2-continued

| SEQ ID NO | Clone ID | Start | Stop | Frame | PFAM Description | E-Value |
|---|---|---|---|---|---|---|
| 114 | 1382924.38 | 880 | 1077 | forward 1 | IBR domain | 7.70E − 23 |
| 114 | 1382924.38 | 4011 | 4430 | forward 3 | Ubiquitin-conjugating enzyme | 1.30E − 57 |
| 114 | 1382924.38 | 679 | 822 | forward 1 | Zinc finger, C3HC4 type (RING finger) | 1.10E − 05 |
| 116 | 4349106CD1 | 4 | 66 | PEPT | KRAB box | 2.40E − 41 |
| 118 | 197587.3 | 910 | 1299 | forward 1 | Fibroblast growth factor | 2.10E − 40 |
| 119 | 403872.1 | 748 | 1218 | forward 1 | PAP2 superfamily | 1.80E − 09 |
| 127 | 3230770CD1 | 771 | 935 | PEPT | Ligand-binding domain of nuclear hormone receptor | 1.10E − 37 |
| 127 | 3230770CD1 | 601 | 676 | PEPT | Zinc finger, C4 type (two domains) | 2.30E − 46 |
| 131 | 408751.3 | 194 | 1204 | forward 2 | Dihydroorotase-like | 1.20E − 12 |
| 131 | 408751.3 | 456 | 1355 | forward 3 | Dihydroorotase-like | 6.60E − 08 |
| 138 | 246336.2 | 568 | 699 | forward 1 | Prenyltransferase and squalene oxidase | 9.20E − 15 |
| 138 | 246336.2 | 449 | 544 | forward 2 | Prenyltransferase and squalene oxidase | 3.10E − 11 |
| 139 | 246336.18 | 931 | 1065 | forward 1 | Prenyltransferase and squalene oxidase | 5.40E − 17 |
| 141 | 253855.2 | 570 | 1919 | forward 3 | AMP-binding enzyme | 2.20E − 10 |
| 142 | 337187.1 | 2027 | 2116 | forward 2 | Squash family of serine protease inhibitors | 1.70E − 04 |
| 144 | 932244CD1 | 218 | 282 | PEPT | Immunoglobulin domain | 4.50E − 07 |
| 147 | 399488.4 | 205 | 1155 | forward 1 | FMN-dependent dehydrogenase | 2.10E − 162 |
| 150 | 237622.11 | 16 | 399 | forward 1 | Uncharacterized protein family UPF0023 | 5.40E − 04 |
| 151 | 237622.6 | 221 | 943 | forward 2 | Uncharacterized protein family UPF0023 | 1.90E − 101 |
| 155 | 334116.1 | 858 | 1004 | forward 3 | PHD-finger | 9.80E − 16 |
| 158 | 407612.1 | 250 | 1524 | forward 1 | 7 transmembrane receptor (rhodopsin family) | 3.00E − 88 |
| 161 | 1004517CD1 | 291 | 390 | PEPT | Cyclic nucleotide-binding domain | 2.20E − 32 |
| 161 | 1004517CD | 7 | 44 | PEPT | Regulatory subunit of type II PKA R-subunit | 2.30E − 17 |
| 162 | 199601.12 | 1 | 411 | forward 1 | LIF / OSM family | 3.40E − 54 |
| 163 | 232946.1 | 242 | 1204 | forward 2 | Zinc-binding dehydrogenases | 1.50E − 55 |
| 165 | 988491CD1 | 3 | 127 | PEPT | Ribosomal protein S8e | 9.90E − 88 |
| 168 | 1674368CD1 | 168 | 209 | PEPT | Fibronectin type II domain | 8.90E − 34 |
| 168 | 1674368CD1 | 975 | 1079 | PEPT | Lectin C-type domain | 3.40E − 43 |
| 168 | 1674368CD1 | 22 | 142 | PEPT | Similarity to lectin domain of ricin beta-chain, 3 copies. | 4.50E − 46 |
| 170 | 464689.54 | 586 | 774 | forward 1 | Cystatin domain | 6.90E − 21 |
| 171 | 222181.1 | 453 | 1208 | forward 3 | 7 transmembrane receptor (rhodopsin family) | 9.10E − 94 |
| 175 | 1079625.3 | 1188 | 1256 | forward 3 | Zinc finger, C2H2 type | 2.50E − 08 |
| 177 | 1275616CD1 | 1 | 115 | PEPT | 60s Acidic ribosomal protein | 3.00E − 41 |
| 178 | 228046.5 | 1093 | 1161 | forward 1 | Zinc finger, C2H2 type | 3.40E − 05 |
| 179 | 1225513.1 | 55 | 240 | forward 1 | Metallothionein | 2.20E − 17 |
| 181 | 232849.13 | 1602 | 1856 | forward 3 | RNA recognition motif. (a.k.a. RRM, RBD, or RNP domain) | 3.80E − 04 |
| 183 | 411148.3 | 2057 | 2173 | forward 2 | WD domain, G-beta repeat | 6.50E − 13 |
| 184 | 444619.13 | 66 | 248 | forward 3 | Metallothionein | 1.90E − 24 |
| 190 | 1098877.1 | 557 | 829 | forward 2 | Ribosomal protein S11 | 3.40E − 51 |
| 190 | 1098877.1 | 481 | 549 | forward 1 | Ribosomal protein S11 | 1.40E − 09 |
| 191 | 251867.2 | 540 | 671 | forward 3 | Ets-domain | 7.20E − 29 |
| 198 | 1571349CD1 | 81 | 135 | PEPT | Helix-turn-helix | 6.50E − 13 |
| 200 | 40322.1 | 165 | 725 | forward 3 | Ras family | 1.00E − 95 |
| 201 | 205542.2 | 745 | 816 | forward 1 | Leucine Rich Repeat | 4.00E − 04 |
| 201 | 205542.2 | 355 | 453 | forward 1 | Leucine rich repeat N-terminal domain | 1.50E − 07 |
| 203 | 1867417CD1 | 34 | 598 | PEPT | DNA topoisomerase II (N-terminal region) | 0.00E + 00 |
| 203 | 1867417CD1 | 713 | 1183 | PEPT | DNA gyrase/topoisomerase IV, subunit A | 1.60E − 191 |
| 210 | 232386.18 | 1184 | 1288 | forward 2 | MYND finger | 1.30E − 06 |
| 212 | 2598244CD1 | 30 | 59 | PEPT | Eukaryotic protein kinase domain | 5.40E − 07 |
| 214 | 2173757CD1 | 385 | 596 | PEPT | DEAD/DEAH box helicase | 1.30E − 74 |
| 214 | 2173757CD1 | 633 | 714 | PEPT | Helicases conserved C-terminal domain | 3.00E − 29 |
| 216 | 1405844CD1 | 9 | 234 | PEPT | Transmembrane 4 family | 1.50E − 130 |
| 220 | 1099294.6 | 456 | 632 | forward 3 | KOW motif | 8.20E − 23 |
| 223 | 241234.1 | 516 | 653 | forward 3 | Ribosomal protein L5 | 2.00E − 07 |
| 223 | 241234.1 | 663 | 980 | forward 3 | Ribosomal L5P family C-terminus | 3.20E − 28 |
| 226 | 138709.5 | 220 | 414 | forward 1 | DnaJ domain | 2.10E − 40 |
| 226 | 138709.5 | 844 | 1212 | forward 1 | DnaJ C terminal region | 1.20E − 10 |
| 227 | 998926.1 | 494 | 595 | forward 2 | TPR Domain | 5.40E − 07 |
| 229 | 1448817CD1 | 30 | 89 | PEPT | Insulin-like growth factor binding proteins | 2.20E − 23 |
| 229 | 1448817CD1 | 176 | 251 | PEPT | Thyroglobulin type-1 repeat | 5.50E − 40 |
| 231 | 245136.4 | 1416 | 1484 | forward 3 | Zinc finger, C2H2 type | 9.60E − 06 |
| 231 | 245136.4 | 1273 | 1341 | forward 1 | Zinc finger, C2H2 type | 8.20E − 05 |
| 241 | 997080.1 | 99 | 1604 | forward 3 | UDP-glucoronosyl and UDP-glucosyl | 1.50E − 285 |
| 242 | 243369.1 | 11 | 253 | forward 2 | Hexokinase | 9.00E − 18 |
| 244 | 322303.15 | 982 | 1188 | forward 1 | Immunoglobulin domain | 1.50E − 08 |
| 244 | 322303.15 | 2600 | 3577 | forward 2 | Eukaryotic protein kinase domain | 2.80E − 70 |
| 245 | 232935.2 | 2003 | 2257 | forward 2 | Fibronectin type III domain | 1.80E − 12 |
| 245 | 232935.2 | 881 | 1066 | forward 2 | Immunoglobulin domain | 3.80E − 13 |
| 247 | 1445507CD1 | 617 | 806 | PEPT | ATPases associated with various cellular activities (AAA) | 2.80E − 91 |
| 249 | 444648.12 | 366 | 548 | forward 3 | Metallothionein | 1.20E − 24 |
| 252 | 1518310CD1 | 1 | 213 | PEPT | Connexin | 5.80E − 163 |
| 264 | 229176.4 | 170 | 322 | forward 2 | Phosphoglucose isomerase | 3.10E − 17 |
| 264 | 229176.4 | 540 | 608 | forward 3 | Phosphoglucose isomerase | 4.50E − 04 |

TABLE 2-continued

| SEQ ID NO | Clone ID | Start | Stop | Frame | PFAM Description | E-Value |
|---|---|---|---|---|---|---|
| 265 | 229176.5 | 1606 | 2439 | forward 1 | Phosphoglucose isomerase | 2.20E − 199 |
| 267 | 124600CD1 | 6 | 189 | PEPT | short chain dehydrogenase | 2.60E − 72 |
| 272 | 238660.5 | 4353 | 4673 | forward 3 | CUB domain | 2.70E − 38 |
| 272 | 238660.5 | 1317 | 1610 | forward 3 | Scavenger receptor cysteine-rich domain | 1.00E − 42 |
| 272 | 238660.5 | 539 | 832 | forward 2 | Scavenger receptor cysteine-rich domain | 3.20E − 42 |
| 272 | 238660.5 | 4707 | 5474 | forward 3 | Zona pellucida-like domain | 9.90E − 70 |
| 275 | 370489.47 | 87 | 452 | forward 3 | Granulocyte-macrophage colony-stimulating | 1.10E − 79 |
| 276 | 197185.2 | 1 | 450 | forward 1 | Cytochrome c/c1 heme lyase | 1.20E − 09 |
| 278 | 1822864CD1 | 310 | 346 | PEPT | EGF-like domain | 1.00E − 06 |
| 278 | 1822864CD1 | 83 | 258 | PEPT | von Willebrand factor type A domain | 5.60E − 55 |
| 282 | 000506CD1 | 343 | 406 | PEPT | RNA recognition motif. (a.k.a. RRM, RBD, or RNP domain) | 6.70E − 18 |
| 283 | 407263.1 | 920 | 1126 | forward 2 | HMG (high mobility group) box | 8.00E − 20 |
| 285 | 1630551CD1 | 90 | 315 | PEPT | Cytochrome C1 family | 6.00E − 171 |
| 287 | 2558815CD1 | 45 | 511 | PEPT | Aldehyde dehydrogenase family | 3.50E − 216 |
| 289 | 92230.2 | 259 | 429 | forward 1 | Homeobox domain | 1.10E − 29 |
| 293 | 2426210CD1 | 6 | 234 | PEPT | short chain dehydrogenase | 2.50E − 50 |
| 296 | 064987CD1 | 475 | 559 | PEPT | Hr1 repeat motif | 1.30E − 21 |
| 296 | 064987CD1 | 1151 | 1234 | PEPT | PH domain | 2.20E − 06 |
| 296 | 064987CD1 | 92 | 354 | PEPT | Eukaryotic protein kinase domain | 1.30E − 74 |
| 306 | 898877.6 | 2344 | 2481 | forward 1 | Myb-like DNA-binding domain | 3.30E − 13 |
| 309 | 2619838CD1 | 861 | 894 | PEPT | TPR Domain | 1.50E − 07 |
| 310 | 369213.42 | 283 | 360 | forward 1 | Transmembrane 4 family | 1.10E − 09 |
| 312 | 3557818CD1 | 444 | 546 | PEPT | PH domain | 1.10E − 19 |
| 312 | 3557818CD1 | 777 | 963 | PEPT | RasGEF domain | 3.00E − 68 |
| 312 | 3557818CD1 | 595 | 650 | PEPT | Guanine nucleotide exchange factor for Ras-like GTPases; N-terminal motif | 4.40E − 18 |
| 312 | 3557818CD1 | 204 | 389 | PEPT | RhoGEF domain | 5.40E − 12 |
| 314 | 001622CD1 | 156 | 472 | PEPT | Eukaryotic protein kinase domain | 3.50E − 59 |
| 324 | 1723834CD1 | 290 | 808 | PEPT | MCM2/3/5 family | 2.40E − 298 |
| 326 | 2551987CD1 | 23 | 262 | PEPT | 3' exoribonuclease family | 1.30E − 75 |
| 328 | 407451.3 | 215 | 445 | forward 2 | Immunoglobulin domain | 7.40E − 07 |
| 329 | 1382931.2 | 956 | 1291 | forward 2 | 60s Acidic ribosomal protein | 2.40E − 36 |
| 329 | 1382931.2 | 353 | 661 | forward 2 | Ribosomal protein L10 | 3.30E − 48 |
| 330 | 1382931.39 | 802 | 882 | forward 1 | 60s Acidic ribosomal protein | 1.60E − 11 |
| 330 | 1382931.39 | 602 | 817 | forward 1 | 60s Acidic ribosomal protein | 1.30E − 10 |
| 330 | 1382931.39 | 152 | 400 | forward 2 | Ribosomal protein L10 | 3.30E − 48 |
| 334 | 401532.3 | 34 | 465 | forward 1 | ABC transporter | 1.20E − 05 |
| 335 | 401532.2 | 1067 | 1882 | forward 2 | ABC transporter transmembrane region. | 4.40E − 44 |
| 335 | 401532.2 | 4082 | 4633 | forward 2 | ABC transporter | 3.40E − 46 |
| 340 | 442308.1 | 294 | 464 | forward 3 | Homeobox domain | 2.70E − 27 |
| 344 | 344166.2 | 954 | 1109 | forward 3 | Transglutaminase-like superfamily | 2.50E − 12 |
| 345 | 1129157.1 | 472 | 930 | forward 1 | F5/8 type C domain | 1.20E − 42 |
| 345 | 1129157.1 | 1012 | 2133 | forward 1 | Zinc carboxypeptidase | 6.30E − 20 |
| 347 | 1804734CD1 | 35 | 246 | PEPT | Major Intrinsic protein | 4.40E − 58 |
| 348 | 43646.7 | 781 | 984 | forward 1 | Annexin | 4.90E − 22 |
| 349 | 43646.1 | 126 | 329 | forward 3 | Annexin | 6.20E − 21 |
| 353 | 415378.3 | 144 | 536 | forward 3 | Reeler domain | 7.50E − 77 |
| 353 | 415378.3 | 1841 | 1984 | forward 2 | Thrombospondin type 1 domain | 3.10E − 23 |
| 358 | 1825508CD1 | 32 | 138 | PEPT | Cystatin domain | 2.60E − 39 |
| 361 | 1095192.1 | 58 | 804 | forward 1 | Ion transport protein | 1.00E − 88 |
| 361 | 1095192.1 | 1195 | 1257 | forward 1 | IQ calmodulin-binding motif | 8.80E − 04 |
| 363 | 1383286.12 | 616 | 801 | forward 1 | Sushi domain (SCR repeat) | 2.00E − 16 |
| 366 | 337156.2 | 361 | 1512 | forward 1 | POT family | 8.30E − 156 |
| 369 | 2125081CD1 | 486 | 799 | PEPT | CNH domain | 4.60E − 130 |
| 369 | 2125081CD1 | 15 | 272 | PEPT | Eukaryotic protein kinase domain | 1.70E − 75 |
| 370 | 1400574.1 | 64 | 132 | forward 1 | Zinc finger, C2H2 type | 4.40E − 07 |
| 370 | 1400574.1 | 357 | 425 | forward 3 | Zinc finger, C2H2 type | 1.60E − 06 |
| 370 | 1400574.1 | 542 | 610 | forward 2 | Zinc finger, C2H2 type | 3.20E − 05 |
| 373 | 2631218CD1 | 106 | 175 | PEPT | RNA recognition motif. (a.k.a. RRM, RBD, or RNP domain) | 2.40E − 14 |
| 375 | 3688791CD1 | 9 | 178 | PEPT | Cyclophilin type peptidyl-prolyl cis-trans | 1.00E − 102 |
| 377 | 3283554CD1 | 22 | 451 | PEPT | Sulfatase | 4.20E − 111 |
| 379 | 4960375CD1 | 113 | 183 | PEPT | RNA recognition motif. (a.k.a. RRM, RBD, or RNP domain) | 6.00E − 14 |
| 382 | 973308.1 | 522 | 671 | forward 3 | KH domain | 1.50E − 15 |
| 383 | 238026.4 | 45 | 293 | forward 3 | Cadherin domain | 2.10E − 10 |
| 385 | 1094829.54 | 1957 | 2151 | forward 1 | bZIP transcription factor | 2.90E − 19 |
| 386 | 899602.1 | 1356 | 1586 | forward 3 | Src homology domain 2 | 1.20E − 15 |
| 387 | 107569.15 | 458 | 1018 | forward 2 | ADP-ribosylation factor family | 1.30E − 05 |
| 387 | 107569.15 | 530 | 1111 | forward 2 | Ras family | 1.60E − 86 |
| 390 | 2705321CD1 | 15 | 364 | PEPT | Fructose-bisphosphate aldolase class-I | 1.60E − 251 |
| 392 | 903491.4 | 286 | 459 | forward 1 | LIM domain containing proteins | 8.30E − 20 |
| 401 | 3676741CD1 | 498 | 566 | PEPT | RNA recognition motif. (a.k.a. RRM, RBD, or RNP domain) | 2.40E − 04 |
| 404 | 1640555CD1 | 232 | 292 | PEPT | Immunoglobulin domain | 6.70E − 12 |
| 409 | 199584.1 | 348 | 485 | forward 3 | KH domain | 4.00E − 04 |

TABLE 2-continued

| SEQ ID NO | Clone ID | Start | Stop | Frame | PFAM Description | E-Value |
|---|---|---|---|---|---|---|
| 415 | 351432.23 | 185 | 889 | forward 2 | HCO3- transporter family | 4.10E − 131 |
| 415 | 351432.23 | 966 | 1145 | forward 3 | HCO3- transporter family | 2.40E − 32 |
| 417 | 1252096CD1 | 23 | 93 | PEPT | RNA recognition motif. (a.k.a. RRM, RBD, or RNP domain) | 3.30E − 22 |
| 419 | 2545475CD1 | 26 | 488 | PEPT | Monocarboxylate transporter | 4.00E − 159 |
| 428 | 222278.1 | 392 | 514 | forward 2 | Thrombospondin type 1 domain | 9.80E − 06 |
| 430 | 1273292CD1 | 29 | 430 | PEPT | Aminotransferases class-1 | 8.60E − 196 |
| 443 | 168861CD1 | 109 | 165 | PEPT | Homeobox domain | 3.20E − 28 |
| 447 | 2026270CD1 | 1 | 130 | PEPT | Parathyroid hormone family | 3.10E − 82 |
| 449 | 522433CD1 | 211 | 308 | PEPT | Transforming growth factor beta like domain | 6.80E − 19 |
| 454 | 3117184CD1 | 89 | 159 | PEPT | RNA recognition motif. (a.k.a. RRM, RBD, or RNP domain) | 1.90E − 09 |
| 456 | 3105671CD1 | 220 | 394 | PEPT | Serum albumin family | 1.20E − 77 |
| 458 | 2051966CD1 | 84 | 137 | PEPT | Sushi domain (SCR repeat) | 4.40E − 17 |
| 463 | 1326983.14 | 590 | 1783 | forward 2 | Transmembrane amino acid transporter | 1.10E − 19 |
| 467 | 1422432CD1 | 53 | 81 | PEPT | EF hand | 1.80E − 04 |
| 467 | 1422432CD1 | 4 | 47 | PEPT | S-100/ICaBP type calcium binding domain | 2.70E − 21 |
| 468 | 409895.2 | 1198 | 1284 | forward 1 | EF hand | 1.80E − 04 |
| 469 | 245136.9 | 874 | 942 | forward 1 | Zinc finger, C2H2 type | 9.70E − 07 |
| 471 | 2600262CD1 | 17 | 388 | PEPT | S-adenosylmethionine synthetase | 0.00E + 00 |
| 473 | 1086183.1 | 308 | 478 | forward 2 | KRAB box | 1.50E − 15 |
| 473 | 1086183.1 | 833 | 901 | forward 2 | Zinc finger, C2H2 type | 1.10E − 06 |
| 474 | 900070.12 | 739 | 1032 | forward 1 | PH domain | 6.90E − 22 |
| 479 | 1256053CD1 | 35 | 148 | PEPT | Fz domain | 1.30E − 65 |
| 479 | 1256053CD1 | 189 | 295 | PEPT | NTR/C345C module | 2.10E − 27 |
| 481 | 201945.4 | 390 | 869 | forward 3 | Peptide methionine sulfoxide reductase | 8.10E − 103 |
| 482 | 235725.21 | 187 | 501 | forward 1 | Protein of unknown function DUF122 | 1.30E − 64 |
| 486 | 481779.1 | 116 | 286 | forward 2 | Homeobox domain | 3.20E − 32 |
| 491 | 199121.14 | 920 | 1150 | forward 2 | Disintegrin | 4.90E − 24 |
| 491 | 199121.14 | 2 | 241 | forward 2 | Reprolysin family propeptide | 1.10E − 13 |
| 491 | 199121.14 | 287 | 871 | forward 2 | Reprolysin (M12B) family zinc metalloprotease | 6.50E − 107 |
| 493 | 1960207CD1 | 23 | 105 | PEPT | Ribosomal protein S24e | 2.40E − 54 |
| 495 | 206866.1 | 102 | 338 | forward 3 | Fork head domain | 3.40E − 53 |
| 495 | 206866.1 | 50 | 109 | forward 2 | Fork head domain | 1.30E − 07 |
| 496 | 1330257.51 | 70 | 1197 | forward 1 | Actin | 9.00E − 287 |
| 503 | 2246292CD1 | 188 | 450 | PEPT | ABC transporter transmembrane region. | 6.00E − 41 |
| 503 | 2246292CD1 | 489 | 673 | PEPT | ABC transporter | 8.80E − 54 |
| 507 | 6301537CD1 | 59 | 759 | PEPT | Myosin head (motor domain) | 0.00E + 00 |
| 516 | 233218.22 | 35 | 571 | forward 2 | Trypsin | 8.50E − 25 |
| 517 | 233218.18 | 656 | 823 | forward 2 | Sushi domain (SCR repeat) | 7.90E − 13 |
| 517 | 233218.18 | 1790 | 2605 | forward 2 | Trypsin | 9.20E − 48 |
| 517 | 233218.18 | 1157 | 1753 | forward 2 | von Willebrand factor type A domain | 4.10E − 63 |
| 521 | 1600311CD1 | 3 | 78 | PEPT | Cytochrome c oxidase subunit VIIa | 1.10E − 55 |
| 525 | 1080598.1 | 277 | 453 | forward 1 | KRAB box | 1.40E − 17 |
| 525 | 1080598.1 | 1081 | 1149 | forward 1 | Zinc finger, C2H2 type | 2.30E − 06 |
| 527 | 2239738CD1 | 140 | 424 | PEPT | Zinc carboxypeptidase | 2.00E − 111 |
| 531 | 1730175CD1 | 539 | 621 | PEPT | Fibronectin type III domain | 4.10E − 22 |
| 531 | 1730175CD1 | 263 | 322 | PEPT | Immunoglobulin domain | 9.10E − 12 |
| 533 | 6825202CD1 | 52 | 519 | PEPT | Cytochrome P450 | 1.50E − 142 |
| 536 | 3027821CD1 | 130 | 405 | PEPT | GTPase of unknown function | 5.40E − 48 |
| 537 | 480736.41 | 107 | 979 | forward 2 | GTPase of unknown function | 4.70E − 05 |
| 546 | 1330220.16 | 214 | 2697 | forward 1 | Hsp90 protein | 0.00E − 00 |
| 546 | 1330220.16 | 984 | 1118 | forward 3 | Hsp90 protein | 2.50E − 23 |
| 548 | 5147.1 | 109 | 354 | forward 1 | Immunoglobulin domain | 9.60E − 06 |
| 552 | 274712.1 | 532 | 1455 | forward 1 | HECT-domain (ubiquitin-transferase). | 1.10E − 115 |
| 557 | 247423.13 | 3016 | 3207 | forward 1 | LIM domain containing proteins | 2.10E − 04 |
| 560 | 1327024.5 | 111 | 392 | forward 3 | SCAN domain | 2.80E − 11 |
| 560 | 1327024.5 | 2889 | 2957 | forward 3 | Zinc finger, C2H2 type | 3.00E − 06 |
| 562 | 2925789CD1 | 90 | 154 | PEPT | DHHC zinc finger domain | 2.30E − 25 |
| 569 | 107939.2 | 162 | 572 | forward 3 | RhoGAP domain | 1.90E − 18 |
| 569 | 107939.2 | 816 | 1424 | forward 3 | START domain | 3.70E − 39 |
| 573 | 296811.1 | 1297 | 1518 | forward 1 | RNA recognition motif. (a.k.a. RRM, RBD, or RNP domain) | 1.60E − 04 |
| 576 | 1859458CD1 | 309 | 546 | PEPT | Glutamine amidotransferase class-1 | 8.90E − 64 |
| 578 | 110960CD1 | 124 | 315 | PEPT | Uncharacterized protein family UPF0005 | 5.30E − 52 |
| 584 | 2466714CD1 | 67 | 446 | PEPT | Transmembrane amino acid transporter | 2.10E − 42 |
| 587 | 246037.28 | 148 | 438 | forward 1 | HMG14 and HMG17 | 2.60E − 19 |
| 590 | 2651836CD1 | 386 | 457 | PEPT | RNA recognition motif. (a.k.a. RRM, RBD, or RNP domain) | 7.00E − 11 |
| 590 | 2651836CD1 | 22 | 56 | PEPT | SAP domain | 4.80E − 12 |
| 596 | 332821.13 | 39 | 488 | forward 3 | Tubulin/FtsZ family | 1.50E − 26 |
| 596 | 332821.13 | 496 | 606 | forward 1 | Tubulin/FtsZ family | 1.00E − 05 |
| 597 | 344186.9 | 62 | 136 | forward 2 | Regulator of G protein signaling domain | 2.40E − 08 |
| 598 | 344186.12 | 256 | 441 | forward 1 | GGL domain | 8.50E − 29 |
| 598 | 344186.12 | 490 | 837 | forward 1 | Regulator of G protein signaling domain | 4.50E − 54 |
| 612 | 212155.1 | 77 | 481 | forward 2 | Lipocalin / cytosolic fatty-acid binding protein family | 8.70E − 30 |

TABLE 2-continued

| SEQ ID NO | Clone ID | Start | Stop | Frame | PFAM Description | E-Value |
|---|---|---|---|---|---|---|
| 615 | 2789525CD1 | 45 | 118 | PEPT | PWI domain | 2.60E − 41 |
| 617 | 1692213CD1 | 35 | 129 | PEPT | PPIC-type PPIASE domain. | 8.90E − 20 |
| 620 | 001089CD1 | 5 | 130 | PEPT | Ribosomal protein S8 | 6.00E − 58 |
| 622 | 002484CD1 | 17 | 118 | PEPT | HIT family | 9.00E − 59 |
| 624 | 669671CD1 | 31 | 177 | PEPT | Proteasome A-type and B-type | 3.30E − 51 |
| 626 | 1344185CD1 | 29 | 64 | PEPT | Pancreatic hormone peptides | 2.30E − 22 |
| 628 | 697785CD1 | 22 | 126 | PEPT | Vertebrate galactoside-binding lectins | 2.90E − 65 |
| 629 | 336435.2 | 488 | 1615 | forward 2 | 7 transmembrane receptor (rhodopsin family) | 2.10E − 105 |
| 632 | 238322.6 | 433 | 1047 | forward 1 | Sema domain | 2.60E − 69 |
| 632 | 238322.6 | 1191 | 1565 | forward 3 | Sema domain | 6.10E − 23 |
| 633 | 55978.9 | 177 | 329 | forward 3 | 3'5'-cyclic nucleotide phosphodiesterase | 7.00E − 09 |
| 634 | 55978.4 | 841 | 1038 | forward 1 | PAS domain | 3.40E − 05 |
| 634 | 55978.4 | 1876 | 2595 | forward 1 | 3'5'-cyclic nucleotide phosphodiesferase | 1.00E − 74 |
| 636 | 238877.11 | 443 | 532 | forward 2 | Zn-finger in Ran binding protein and others. | 1.60E − 04 |
| 637 | 238877.8 | 126 | 215 | forward 3 | Zn-finger in Ran binding protein and others. | 1.60E − 04 |
| 638 | 997231.15 | 99 | 584 | forward 3 | Glycosyl transferases | 1.40E − 11 |
| 639 | 997231.16 | 100 | 615 | forward 1 | Glycosyl transferases | 3.20E − 23 |
| 640 | 346209.3 | 852 | 914 | forward 3 | IQ calmodulin-binding motif | 6.70E − 05 |
| 640 | 346209.3 | 246 | 806 | forward 3 | Myosin head (motor domain) | 7.20E − 92 |
| 640 | 346209.3 | 1710 | 4286 | forward 3 | Myosin toil | 2.00E − 181 |
| 642 | 2515666CD1 | 42 | 499 | PEPT | Cytochrome P450 | 2.00E − 159 |
| 644 | 2742913CD1 | 5 | 259 | PEPT | Eukaryotic-type carbonic anhydrase | 3.90E − 193 |
| 645 | 336615.1 | 86 | 874 | forward 2 | Tub family | 3.00E − 195 |
| 655 | 3721108CD1 | 273 | 432 | PEPT | Ligand-binding domain of nuclear hormone receptor | 2.70E − 48 |
| 655 | 3721108CD1 | 85 | 162 | PEPT | Zinc finger, C4 type (two domains) | 9.60E − 35 |
| 664 | 2636759CD1 | 54 | 200 | PEPT | Dual specificity phosphatase, catalytic | 6.90E − 20 |
| 668 | 1322.4 | 1105 | 1560 | forward 1 | RhoGAP domain | 8.20E − 28 |
| 671 | 345272.2 | 1714 | 2052 | forward 1 | PX domain | 4.30E − 15 |
| 671 | 345272.2 | 172 | 672 | forward 1 | Domain associated with PX domains | 1.40E − 06 |
| 673 | 231840.1 | 24 | 758 | forward 3 | Cation efflux family | 1.80E − 44 |
| 675 | 253783.6 | 5 | 214 | forward 2 | RNA recognition motif. (a.k.a. RRM, RBD, or RNP domain) | 6.40E − 21 |
| 679 | 1325741.2 | 2201 | 2395 | forward 2 | RNA recognition motif. (a.k.a. RRM, RBD, or RNP domain) | 4.00E − 06 |
| 681 | 2703282CD1 | 135 | 201 | PEPT | SAM domain (Sterile alpha motif) | 1.10E − 04 |
| 682 | 118836.2 | 161 | 277 | forward 2 | Bacterial mutT protein | 1.70E − 06 |
| 683 | 3303.2 | 372 | 1658 | forward 3 | Dwarfin | 3.20E − 249 |
| 690 | 175918.15 | 2703 | 2918 | forward 3 | RNA recognition motif. (a.k.a. RRM, RBD, or RNP domain) | 7.00E − 09 |
| 691 | 1068290.1 | 359 | 544 | forward 2 | KRAB box | 3.80E − 27 |
| 691 | 1068290.1 | 2439 | 2507 | forward 3 | Zinc finger, C2H2 type | 5.00E − 08 |
| 691 | 1068290.1 | 1511 | 1579 | forward 2 | Zinc finger, C2H2 type | 3.70E − 05 |
| 709 | 1508254CD1 | 16 | 463 | PEPT | Hexokinase | 0.00E + 00 |
| 711 | 207452CD1 | 14 | 310 | PEPT | Mitochondrial carrier proteins | 4.50E − 67 |
| 724 | 201395.4 | 2434 | 2694 | forward 1 | Fibronectin type III domain | 3.10E − 18 |
| 724 | 201395.4 | 2173 | 2349 | forward 1 | Immunoglobulin domain | 4.10E − 10 |
| 726 | 4295277CD1 | 1929 | 1945 | PEPT | Neuraxin and MAP 1B proteins | 1.20E − 08 |
| 731 | 1837317CD1 | 1 | 375 | PEPT | Actin | 1.90E − 286 |
| 733 | 2937262CD1 | 127 | 211 | PEPT | RNA recognition motif. (a.k.a. RRM, RBD, or RNP domain) | 5.80E − 16 |
| 734 | 199290.9 | 2261 | 3211 | forward 2 | Eukaryotic protein kinase domain | 2.50E − 41 |
| 742 | 2847188CD1 | 80 | 121 | PEPT | Calcitonin / CGRP / IAPP family | 7.30E − 26 |
| 745 | 1330212.14 | 147 | 542 | forward 3 | Ribosomal protein L11 | 4.90E − 64 |
| 750 | 1330122.1 | 13473 | 14789 | forward 3 | Sodium:solute symporter family | 4.40E − 256 |
| 757 | 1719478CD1 | 1177 | 1445 | PEPT | Ion transport protein | 2.00E − 100 |
| 769 | 1001589CD1 | 972 | 1065 | PEPT | Nucleotidyltransferase domain | 4.40E − 11 |
| 770 | 7808.1 | 1559 | 1750 | forward 2 | DENN (AEX-3) domain | 4.80E − 30 |
| 770 | 7808.1 | 1366 | 1593 | forward 1 | DENN (AEX-3) domain | 7.10E − 21 |
| 773 | 474622.1 | 918 | 1100 | forward 3 | P21-Rho-binding domain | 1.50E − 25 |
| 773 | 474622.1 | 411 | 725 | forward 3 | WH1 domain | 2.30E − 29 |
| 773 | 474622.1 | 1608 | 1661 | forward 3 | Wiskott Aldrich syndrome homology region 2 | 5.20E − 06 |
| 775 | 1383009.67 | 2659 | 3000 | forward 1 | 60s Acidic ribosomal protein | 3.30E − 49 |
| 777 | 1086355.1 | 105 | 173 | forward 3 | Zinc finger, C2H2 type | 1.10E − 04 |
| 779 | 1384716.4 | 315 | 941 | forward 3 | L1P family of ribosomal proteins | 1.60E − 101 |
| 779 | 1384716.4 | 986 | 1150 | forward 2 | Ribosomal protein L3 | 5.60E − 31 |
| 787 | 035282CD1 | 191 | 416 | PEPT | DEAD/DEAH box helicase | 3.20E − 70 |
| 787 | 035282CD1 | 453 | 534 | PEPT | Helicases conserved C-terminal domain | 6.40E − 36 |
| 788 | 350667.7 | 548 | 697 | forward 2 | DEAD/DEAH box helicase | 1.50E − 18 |
| 793 | 1806212CD1 | 707 | 744 | PEPT | tRNA synthetases class I (C) | 9.60E − 4 |
| 795 | 4436028CD1 | 99 | 170 | PEPT | RNA recognition motif. (a.k.a. RRM, RBD, or RNP domain) | 7.30E − 26 |
| 804 | 344017.6 | 1930 | 1998 | forward 1 | Zinc finger, C2H2 type | 4.00E − 04 |
| 807 | 2770104CD1 | 86 | 144 | PEPT | Immunoglobulin domain | 5.60E − 07 |
| 810 | 2641740CD1 | 119 | 415 | PEPT | Phosphatidylinositol-4-phosphate 5-Kinase | 2.90E − 150 |
| 815 | 170915CD1 | 131 | 255 | PEPT | C1q domain | 4.80E − 29 |
| 815 | 170915CD1 | 65 | 123 | PEPT | Collagen triple helix repeat (20 copies) | 2.20E − 04 |

TABLE 2-continued

| SEQ ID NO | Clone ID | Start | Stop | Frame | PFAM Description | E-Value |
|---|---|---|---|---|---|---|
| 820 | 427967.4 | 2859 | 2960 | forward 3 | TPR Domain | 1.50E − 07 |
| 822 | 215158.5 | 1243 | 1377 | forward 1 | AN1-like Zinc finger | 9.10E − 04 |
| 837 | 1850670CD1 | 257 | 295 | PEPT | Low-density lipoprotein receptor domain | 1.90E − 14 |
| 837 | 1850670CD1 | 117 | 215 | PEPT | Scavenger receptor cysteine-rich domain | 1.90E − 33 |
| 837 | 1850670CD1 | 340 | 569 | PEPT | Trypsin | 5.30E − 87 |
| 841 | 1330056CD1 | 328 | 408 | PEPT | PCI domain | 7.70E − 25 |
| 842 | 199788.2 | 234 | 806 | forward 3 | Ras family | 3.80E − 94 |
| 850 | 997194.1 | 216 | 1151 | forward 3 | Intermediate filament proteins | 8.20E − 139 |
| 861 | 1073168.6 | 505 | 780 | forward 1 | Ubiquitin carboxyl-terminal hydrolase family 2 | 2.70E − 21 |
| 862 | 1073168.8 | 239 | 334 | forward 2 | Ubiquitin carboxyl-terminal hydrolases family | 4.70E − 08 |
| 862 | 1073168.8 | 1022 | 1297 | forward 2 | Ubiquitin carboxyl-terminal hydrolase family 2 | 2.70E − 21 |
| 871 | 404952.4 | 557 | 727 | forward 2 | SH3 domain | 2.20E − 14 |
| 872 | 404952.1 | 132 | 410 | forward 3 | Fes/CIP4 homology domain | 5.50E − 04 |
| 872 | 404952.1 | 1457 | 1627 | forward 2 | SH3 domain | 2.50E − 16 |
| 874 | 348390.2 | 108 | 449 | forward 3 | Actin | 9.40E − 62 |
| 877 | 253550.2 | 627 | 845 | forward 3 | Thyroglobulin type-1 repeat | 1.50E − 32 |
| 885 | 399474.1 | 733 | 984 | forward 1 | IPT/TIG domain | 3.50E − 19 |
| 889 | 5202390CD1 | 288 | 393 | PEPT | Calponin homology (CH) domain | 2.40E − 17 |
| 895 | 998930.1 | 353 | 577 | forward 2 | Caseins | 7.00E − 04 |
| 898 | 1082203.1 | 961 | 1029 | forward 1 | Zinc finger, C2H2 type | 2.30E − 08 |
| 899 | 225420.1 | 2179 | 2319 | forward 1 | Phorbol esters/diacylglycerol binding domain (C1 domain) | 5.60E − 04 |
| 907 | 977975.1 | 603 | 701 | forward 3 | Ank repeat | 2.40E − 08 |
| 909 | 1505038CD1 | 54 | 98 | PEPT | Kazal-type serine protease Inhibitor domain | 7.20E − 12 |
| 911 | 262830CD1 | 204 | 291 | PEPT | Fibronectin type III domain | 2.90E − 09 |
| 911 | 262830CD1 | 39 | 91 | PEPT | Immunoglobulin domain | 1.10E − 07 |
| 913 | 3607580CD1 | 61 | 318 | PEPT | 7 transmembrane receptor (rhodopsin family) | 5.40E − 100 |
| 917 | 252649.14 | 225 | 911 | forward 3 | Ras family | 3.00E − 30 |
| 921 | 1384719.3 | 1221 | 1457 | forward 3 | Platelet-derived growth factor (PDGF) | 2.50E − 53 |
| 924 | 481118.7 | 1097 | 1198 | forward 2 | TPR Domain | 6.90E − 05 |
| 926 | 337528.4 | 611 | 964 | forward 2 | Nerve growth factor family | 1.10E − 62 |
| 928 | 3687719CD1 | 18 | 113 | PEPT | Fork head domain | 2.50E − 64 |
| 931 | 1530186CD1 | 152 | 412 | PEPT | 7 transmembrane receptor (Secretin family) | 1.30E − 59 |
| 931 | 1530186CD1 | 90 | 143 | PEPT | Latrophilin/CL-1-like GPS domain | 2.10E − 16 |
| 938 | 3257507CD1 | 62 | 317 | PEPT | AP endonuclease family 1 | 7.20E − 134 |
| 939 | 1400580.1 | 416 | 484 | forward 2 | Zinc finger, C2H2 type | 3.00E − 06 |
| 941 | 346716.17 | 4829 | 4975 | forward 2 | Phorbol esters/diacylglycerol binding domain (C1 domain) | 1.60E − 07 |
| 941 | 346716.17 | 442 | 2022 | forward 1 | Myosin head (motor domain) | 9.10E − 202 |
| 941 | 346716.17 | 2396 | 2761 | forward 2 | Myosin head (motor domain) | 2.60E − 37 |
| 941 | 346716.17 | 43 | 342 | forward 1 | Ras association (RalGDS/AF-6) domain | 1.20E − 33 |
| 941 | 346716.17 | 5069 | 5518 | forward 2 | RhoGAP domain | 2.60E − 49 |
| 943 | 1384720.16 | 1060 | 1533 | forward 1 | Actin | 1.40E − 88 |
| 943 | 1384720.16 | 1475 | 1513 | forward 1 | Actin | 4.10E − 05 |
| 945 | 1505790CD1 | 138 | 194 | PEPT | Homeobox domain | 8.60E − 30 |
| 947 | 3876162CD1 | 60 | 429 | PEPT | Calreticulin family | 1.90E − 220 |
| 958 | 2852561CD1 | 112 | 491 | PEPT | Alpha amylase | 1.70E − 04 |
| 960 | 988704.25 | 257 | 448 | forward 2 | RNA recognition motif. (a.k.a. RRM, RBD, or RNP domain) | 6.30E − 20 |
| 961 | 988704.26 | 185 | 376 | forward 2 | RNA recognition motif. (a.k.a. RRM, RBD, or RNP domain) | 6.30E − 20 |
| 965 | 5371205CD1 | 254 | 402 | PEPT | DENN (AEX-3) domain | 6.90E − 86 |
| 974 | 1089708.18 | 3154 | 3279 | forward 1 | G-patch domain | 7.90E − 10 |
| 974 | 1089708.18 | 2622 | 2786 | forward 3 | Surp module | 1.80E − 20 |
| 977 | 088957CD1 | 28 | 202 | PEPT | Serum albumin family | 1.20E − 89 |
| 978 | 220943.21 | 225 | 1517 | forward 3 | Integrins, beta chain | 0.00E + 00 |
| 985 | 346641.3 | 313 | 1212 | forward 1 | Actin | 6.50E − 40 |
| 985 | 346641.3 | 126 | 221 | forward 3 | Actin | 2.40E − 04 |
| 996 | 242010.6 | 8 | 1336 | forward 2 | Hsp70 protein | 7.20E − 47 |
| 996 | 242010.6 | 19 | 1254 | forward 1 | Hsp70 protein | 2.10E − 04 |
| 1000 | 678004CD1 | 251 | 410 | PEPT | Ligand-binding domain of nuclear hormone receptor | 3.70E − 33 |
| 1000 | 678004CD1 | 72 | 146 | PEPT | Zinc finger, C4 type (two domains) | 7.60E − 47 |
| 1002 | 411373.7 | 437 | 1744 | forward 2 | Sema domain | 9.50E − 211 |
| 1005 | 343924.8 | 2678 | 2776 | forward 2 | FATC domain | 5.50E − 09 |
| 1009 | 029251CD1 | 79 | 305 | PEPT | Fibrinogen beta and gamma chains, C-terminal globular domain | 1.60E − 103 |
| 1010 | 335648.1 | 208 | 1416 | forward 1 | Aminotransferases class-I | 1.70E − 138 |
| 1011 | 331108.1 | 70 | 1728 | forward 1 | Lipoprotein amino terminal region | 1.10E − 187 |
| 1015 | 1262593.2 | 467 | 568 | forward 2 | TPR Domain | 3.30E − 11 |
| 1017 | 233660.2 | 514 | 756 | forward 1 | Ubiquitin carboxyl-terminal hydrolase family 2 | 7.60E − 25 |
| 1023 | 200051.1 | 2 | 646 | forward 2 | MAGE family | 3.90E − 09 |
| 1024 | 1197030.1 | 987 | 1145 | forward 3 | Ribosomal protein L30p/L7e | 2.30E − 28 |
| 1025 | 1197030.1 | 420 | 578 | forward 3 | Ribosomal protein L30p/L7e | 2.30E − 28 |
| 1029 | 4832672CD1 | 17 | 135 | PEPT | Core histone H2A/H2B/H3/H4 | 1.40E − 29 |
| 1032 | 342074.1 | 3 | 287 | forward 3 | Sodium:neurotransmitter symporter family | 1.60E − 46 |
| 1035 | 1852849CD1 | 130 | 163 | PEPT | TPR Domain | 2.60E − 05 |

TABLE 2-continued

| SEQ ID NO | Clone ID | Start | Stop | Frame | PFAM Description | E-Value |
|---|---|---|---|---|---|---|
| 1039 | 13039.2 | 2886 | 3119 | forward 3 | Fibronectin type III domain | 3.00E − 09 |
| 1044 | 1383263.14 | 581 | 916 | forward 2 | Thioredoxin | 4.00E − 55 |
| 1047 | 1051954.7 | 1747 | 1815 | forward 1 | Zinc finger, C2H2 type | 2.60E − 07 |
| 1050 | 335568.1 | 638 | 877 | forward 2 | Immunoglobulin domain | 6.70E − 05 |
| 1052 | 272273.1 | 1 | 384 | forward 1 | Cadherin cytoplasmic region | 2.00E − 64 |
| 1053 | 399133.9 | 567 | 1196 | forward 3 | Eukaryotic protein kinase domain | 6.20E − 15 |
| 1055 | 246727.17 | 469 | 678 | forward 1 | RNA recognition motif. (a.k.a. RRM, RBD, or RNP domain) | 1.00E − 13 |
| 1058 | 1383039.17 | 13 | 828 | forward 1 | Hsp70 protein | 3.20E − 11 |
| 1064 | 210133.1 | 836 | 904 | forward 1 | Zinc finger, C2H2 type | 4.80E − 07 |
| 1065 | 430665.1 | 78 | 257 | forward 3 | Metallothionein | 4.10E − 22 |
| 1066 | 902525.1 | 597 | 908 | forward 3 | Ribosomal L22e protein family | 7.10E − 35 |
| 1071 | 233218.7 | 22 | 561 | forward 1 | von Willebrand factor type A domain | 2.00E − 04 |
| 1072 | 1092387.12 | 374 | 439 | forward 2 | Aldo/keto reductase family | 8.80E − 08 |
| 1076 | 1382920.38 | 253 | 723 | forward 1 | Ferritins | 9.80E − 116 |
| 1079 | 1089210.1 | 61 | 903 | forward 1 | Aldo/keto reductase family | 6.10E − 172 |
| 1080 | 444619.9 | 649 | 804 | forward 1 | Metallothionein | 2.60E − 12 |
| 1082 | 462057.1 | 1074 | 1322 | forward 3 | PDZ domain (Also known as DHR or GLGF). | 8.00E − 14 |
| 1083 | 197902.12 | 1079 | 1183 | forward 2 | EGF-like domain | 7.80E − 05 |
| 1083 | 197902.12 | 710 | 826 | forward 2 | Low-density lipoprotein receptor domain | 4.90E − 19 |
| 1083 | 197902.12 | 1703 | 1831 | forward 2 | Low-density lipoprotein receptor repeat class | 4.30E − 17 |
| 1084 | 997394.4 | 2006 | 2311 | forward 2 | Guanylate kinase | 1.30E − 05 |
| 1084 | 997394.4 | 1295 | 1537 | forward 2 | PDZ domain (Also known as DHR or GLGF). | 2.30E − 19 |
| 1091 | 221042.1 | 1094 | 1330 | forward 2 | Ubiquitin family | 1.40E − 08 |
| 1097 | 3505463CD1 | 4 | 172 | PEPT | ADP-ribosylation factor family | 2.60E − 05 |
| 1097 | 3505463CD1 | 10 | 213 | PEPT | Ras family | 1.40E − 89 |
| 1102 | 1330139.5 | 775 | 1035 | forward 1 | EF-1 guanine nucleotide exchange domain | 2.20E − 56 |
| 1103 | 977951.1 | 1817 | 2035 | forward 2 | Prolyl oligopeptidase family | 1.60E − 10 |
| 1104 | 347316.1 | 3514 | 4311 | forward 1 | Ion transport protein | 1.40E − 97 |
| 1104 | 347316.1 | 516 | 1385 | forward 3 | Ion transport protein | 3.20E − 58 |
| 1114 | 243924.12 | 117 | 326 | forward 3 | RNA recognition motif. (a.k.a. RRM, RBD, or RNP domain) | 5.00E − 24 |
| 1115 | 243924.13 | 635 | 847 | forward 2 | RNA recognition motif. (a.k.a. RRM, RBD, or RNP domain) | 3.50E − 27 |
| 1120 | 403994.5 | 213 | 599 | forward 3 | Sodium/calcium exchanger protein | 1.60E − 23 |
| 1122 | 337250.1 | 71 | 211 | forward 2 | Kelch motif | 3.70E − 18 |
| 1123 | 410781.1 | 211 | 600 | forward 1 | Fibroblast growth factor | 2.70E − 43 |
| 1124 | 347759.3 | 3 | 407 | forward 3 | Actin | 9.80E − 98 |
| 1125 | 1252060.4 | 308 | 850 | forward 2 | Serum albumin family | 1.00E − 33 |
| 1126 | 209279.1 | 3236 | 4360 | forward 2 | Serpins (serine protease inhibitors) | 2.90E − 217 |
| 1126 | 209279.1 | 2193 | 2333 | forward 3 | Serpins (serine protease inhibitors) | 4.70E − 19 |
| 1127 | 418391.2 | 322 | 654 | forward 1 | BTB/POZ domain | 6.10E − 12 |
| 1127 | 418391.2 | 1423 | 1566 | forward 1 | Kelch motif | 5.30E − 55 |

TABLE 3

| SEQ ID NO | Template ID | Clone ID | Start | Stop |
|---|---|---|---|---|
| 1 | 230040.1 | 13504 | 1011 | 1342 |
| 2 | 175138.1 | 21957 | 1 | 274 |
| 3 | 1863336CB1 | 41247 | 1507 | 1670 |
| 5 | 343861.16 | 41479 | 781 | 1092 |
| 6 | 3170236CB1 | 89691 | 80 | 237 |
| 8 | 259805.54 | 96752 | 614 | 762 |
| 9 | 1460258CB1 | 120110 | 1740 | 2693 |
| 11 | 1016903.1 | 126877 | 2444 | 3200 |
| 12 | 65385.7 | 128963 | 2517 | 2815 |
| 13 | 3714.1 | 129775 | 45 | 460 |
| 14 | 1720920CB1 | 136073 | 2692 | 3093 |
| 16 | 256009.48 | 139949 | 607 | 1194 |
| 17 | 1055233.1 | 143765 | 1 | 206 |
| 18 | 2114865CB1 | 167081 | 239 | 685 |
| 20 | 1383740.1 | 168848 | 365 | 1279 |
| 21 | 2700132CB1 | 172023 | 6933 | 7334 |
| 23 | 231621.1 | 195943 | 70 | 756 |
| 24 | 216485.1 | 198719 | 1105 | 1598 |
| 25 | 406004.2 | 198959 | 1 | 388 |
| 26 | 1399930.1 | 220378 | 1066 | 1687 |
| 27 | 414171.33 | 223436 | −6 | 510 |
| 28 | 230895.1 | 262712 | −1 | 1625 |
| 29 | 22827.1 | 269310 | 66 | 424 |
| 30 | 346663.6 | 275757 | 1 | 579 |
| 31 | 96422.1 | 278100 | −1 | 558 |
| 32 | 405833.1 | 278939 | 332 | 699 |
| 33 | 995839.2 | 279898 | 41 | 352 |
| 34 | 2517374CB1 | 293477 | 392 | 837 |
| 36 | 1255456CB1 | 301206 | 742 | 825 |
| 38 | 3084.1 | 305751 | 1 | 421 |
| 39 | 302123.12 | 309006 | −6 | 285 |
| 40 | 533825CB1 | 322933 | 90 | 343 |
| 42 | 220845.2 | 339737 | 1 | 584 |
| 43 | 985475.8 | 346017 | 850 | 1309 |
| 44 | 198309.7 | 371201 | 132 | 401 |
| 45 | 1382869.18 | 380006 | 1104 | 1482 |
| 46 | 1382869.1 | 380006 | 1375 | 1774 |
| 47 | 352049.1 | 380041 | 0 | 393 |
| 48 | 215990.2 | 389558 | 4639 | 5188 |
| 49 | 428335.59 | 400654 | 1529 | 2081 |
| 50 | 1561192CB1 | 408442 | 1005 | 1251 |
| 52 | 1330151.46 | 409209 | 859 | 1181 |
| 53 | 1330151.49 | 409209 | 1278 | 1917 |
| 54 | 404028.1 | 417432 | 86 | 618 |
| 55 | 996427.2 | 419492 | 801 | 2458 |
| 56 | 21971.1 | 428897 | 132 | 838 |
| 57 | 215205.1 | 434751 | 1 | 337 |
| 58 | 400650.3 | 435549 | 954 | 1283 |
| 59 | 344524.1 | 435610 | 2868 | 3547 |
| 60 | 196709.1 | 439415 | 26 | 770 |

TABLE 3-continued

| SEQ ID NO | Template ID | Clone ID | Start | Stop |
|---|---|---|---|---|
| 61 | 37502.4 | 451090 | 5285 | 6112 |
| 62 | 235687.5 | 459372 | 177 | 614 |
| 63 | 085596CB1 | 481402 | 1413 | 1876 |
| 65 | 234811.3 | 489820 | 773 | 1600 |
| 66 | 3393396CB1 | 494905 | 166 | 2601 |
| 68 | 978439.4 | 495808 | 1632 | 4489 |
| 69 | 11390.1 | 496946 | 1 | 242 |
| 70 | 1382924.42 | 508943 | 1 | 536 |
| 71 | 1256895CB1 | 509758 | 1211 | 2418 |
| 73 | 11115.1 | 509839 | 1 | 530 |
| 74 | 291267.1 | 517374 | 2520 | 3328 |
| 75 | 3125723CB1 | 523797 | 3368 | 3846 |
| 77 | 980593.1 | 526319 | 1 | 422 |
| 78 | 980593.6 | 526319 | 484 | 1061 |
| 79 | 410739.1 | 531505 | 1 | 714 |
| 80 | 405773.2 | 531842 | 493 | 1490 |
| 81 | 210871.1 | 538427 | 1 | 428 |
| 82 | 20265.2 | 548114 | 1 | 172 |
| 83 | 39840.1 | 554654 | 435 | 1066 |
| 84 | 088564CB1 | 560115 | 341 | 785 |
| 86 | 28889.1 | 562585 | 216 | 433 |
| 87 | 410611.1 | 566093 | 1 | 476 |
| 88 | 212533.1 | 569348 | 792 | 1393 |
| 89 | 24081.12 | 592085 | 1381 | 1834 |
| 90 | 983961.1 | 597555 | 526 | 850 |
| 91 | 1383290.2 | 608725 | 1290 | 1682 |
| 92 | 337221.11 | 615776 | 1501 | 2328 |
| 93 | 290344.1 | 617587 | 3430 | 3905 |
| 94 | 290344.3 | 617587 | 72 | 655 |
| 95 | 222714.1 | 619447 | 1 | 340 |
| 96 | 2230.1 | 620879 | 31 | 424 |
| 97 | 34424.1 | 621216 | 627 | 944 |
| 98 | 153237.1 | 621543 | 1 | 772 |
| 99 | 272843.14 | 622565 | 4919 | 5454 |
| 100 | 234729.3 | 626254 | 482 | 1134 |
| 101 | 349647.1 | 626471 | 23 | 595 |
| 102 | 236457.1 | 630375 | 364 | 1203 |
| 103 | 230193.1 | 641039 | 2371 | 3152 |
| 104 | 213429.1 | 641510 | 102 | 930 |
| 105 | 5124.22 | 646463 | 290 | 740 |
| 106 | 88974.2 | 654246 | 87 | 598 |
| 107 | 903909.1 | 660142 | 1298 | 2133 |
| 108 | 196981.1 | 664625 | 331 | 898 |
| 109 | 337888.3 | 668460 | 1357 | 1872 |
| 110 | 795.1 | 671717 | 32 | 507 |
| 111 | 3070147CB1 | 678955 | 138 | 472 |
| 113 | 20525.1 | 686993 | 1 | 418 |
| 114 | 1382924.38 | 689296 | 1 | 407 |
| 115 | 4349106CB1 | 693783 | 356 | 1042 |
| 117 | 247185.1 | 699113 | 178 | 527 |
| 118 | 197587.3 | 739461 | 2482 | 2899 |
| 119 | 403872.1 | 746910 | 1943 | 2406 |
| 120 | 900993.1 | 748477 | 130 | 553 |
| 121 | 228511.1 | 755223 | 5386 | 5782 |
| 122 | 406975.2 | 757370 | 366 | 806 |
| 123 | 200171.17 | 757514 | 110 | 501 |
| 124 | 291155.1 | 761282 | 371 | 646 |
| 125 | 1383047.1 | 777716 | 130 | 433 |
| 126 | 3230770CB1 | 819036 | 3058 | 3489 |
| 128 | 481453.1 | 830408 | 1 | 845 |
| 129 | 216141.1 | 835756 | 1 | 445 |
| 130 | 158318.1 | 854872 | 51 | 501 |
| 131 | 408751.3 | 859218 | 990 | 1600 |
| 132 | 998310.1 | 865145 | 1 | 263 |
| 133 | 1097471.1 | 868678 | 595 | 1061 |
| 134 | 983843.2 | 869702 | 1 | 527 |
| 135 | 983843.1 | 869702 | 410 | 521 |
| 136 | 985607.8 | 870396 | 4108 | 4955 |
| 137 | 152298.2 | 872017 | 84 | 834 |
| 138 | 246336.2 | 891072 | 338 | 781 |
| 139 | 246336.18 | 891072 | 1016 | 1301 |
| 140 | 405126.1 | 893224 | 1 | 330 |
| 141 | 253855.2 | 898741 | 4545 | 5026 |
| 142 | 337187.1 | 916103 | 2235 | 2623 |
| 143 | 932244CB1 | 932244 | 563 | 1212 |
| 145 | 160952.1 | 951433 | 1 | 541 |
| 146 | 13343.1 | 955538 | 483 | 864 |
| 147 | 399488.4 | 960496 | 385 | 695 |
| 148 | 399488.5 | 960496 | 347 | 723 |
| 149 | 28048.1 | 960604 | 1 | 103 |
| 150 | 237622.11 | 963331 | 1 | 319 |
| 151 | 237622.6 | 963331 | 1122 | 1603 |
| 152 | 26612.1 | 964939 | 1 | 611 |
| 153 | 413806.9 | 997480 | 760 | 1111 |
| 154 | 162569.1 | 998615 | 1 | 498 |
| 155 | 334116.1 | 1001486 | 3673 | 4838 |
| 156 | 396837.1 | 1004382 | 1073 | 1529 |
| 157 | 406507.1 | 1209413 | 267 | 787 |
| 158 | 407612.1 | 1210839 | 3166 | 3865 |
| 159 | 399501.1 | 1211357 | 666 | 1043 |
| 160 | 1004517CB1 | 1214989 | 2645 | 3017 |
| 162 | 199601.12 | 1219506 | 1048 | 1557 |
| 163 | 232946.1 | 1235345 | 4929 | 5565 |
| 164 | 988491CB1 | 1235535 | 256 | 704 |
| 166 | 199882.12 | 1236305 | 1 | 336 |
| 167 | 1674368CB1 | 1241484 | 3525 | 3926 |
| 169 | 115268.8 | 1251065 | 137 | 581 |
| 170 | 464689.54 | 1259841 | 150 | 1047 |
| 171 | 222181.1 | 1266985 | 2454 | 3205 |
| 172 | 2951538CB1 | 1268277 | 57 | 655 |
| 174 | 1087445.1 | 1269921 | 1006 | 1486 |
| 175 | 1079625.3 | 1274378 | 1889 | 2503 |
| 176 | 1275616CB1 | 1275616 | 33 | 577 |
| 178 | 228046.5 | 1284155 | 5543 | 6165 |
| 179 | 1225513.1 | 1299246 | 11 | 304 |
| 180 | 203438.2 | 1303862 | 1 | 335 |
| 181 | 232849.13 | 1305249 | 709 | 2219 |
| 182 | 19598.1 | 1306062 | 108 | 493 |
| 183 | 411148.3 | 1306222 | 4315 | 4784 |
| 184 | 444619.13 | 1308729 | −2 | 363 |
| 185 | 1383714.1 | 1310337 | 1 | 328 |
| 186 | 1273641CB1 | 1315663 | 699 | 1247 |
| 188 | 403717.1 | 1316801 | 174 | 946 |
| 189 | 332165.8 | 1317428 | 743 | 1342 |
| 190 | 1098877.1 | 1319021 | 393 | 520 |
| 191 | 251867.2 | 1320685 | 73 | 731 |
| 192 | 5597.1 | 1323327 | 134 | 586 |
| 193 | 235356.1 | 1323616 | 1429 | 1883 |
| 194 | 47593.1 | 1326255 | 1 | 794 |
| 195 | 995887.12 | 1328741 | 1022 | 1726 |
| 196 | 245687.1 | 1329625 | 2596 | 2872 |
| 197 | 1571349CB1 | 1331853 | 8 | 414 |
| 199 | 336735.1 | 1337924 | 193 | 1125 |
| 200 | 40322.1 | 1342744 | 33 | 1267 |
| 201 | 205542.2 | 1350683 | 3976 | 4510 |
| 202 | 1867417CB1 | 1357231 | 3074 | 3751 |
| 204 | 402521.1 | 1364694 | 1 | 402 |
| 205 | 219537.2 | 1365045 | 1 | 254 |
| 206 | 219537.1 | 1365645 | 33 | 487 |
| 207 | 1041138.7 | 1366040 | 953 | 1310 |
| 208 | 49272.1 | 1370137 | 1 | 381 |
| 209 | 221433.21 | 1377668 | 295 | 984 |
| 210 | 232386.18 | 1383138 | 1336 | 1927 |
| 211 | 2598244CB1 | 1398105 | 2385 | 2998 |
| 213 | 2173757CB1 | 1401312 | 1953 | 2582 |
| 215 | 1405844CB1 | 1405844 | 72 | 1165 |
| 217 | 1143377.5 | 1407125 | 300 | 991 |
| 218 | 235147.1 | 1415119 | 3245 | 3728 |
| 219 | 235147.2 | 1415119 | 1096 | 1448 |
| 220 | 1099294.6 | 1416978 | 36 | 785 |
| 221 | 330927.1 | 1418276 | 410 | 940 |
| 222 | 50695.1 | 1425150 | 1 | 506 |
| 223 | 241234.1 | 1437552 | 15 | 1037 |
| 224 | 282397.77 | 1441245 | 2551 | 6114 |
| 225 | 984009.2 | 1446475 | 68 | 808 |
| 226 | 138709.5 | 1447306 | 1263 | 2152 |
| 227 | 998926.1 | 1448572 | 2563 | 3107 |
| 228 | 1448817CB1 | 1449819 | 578 | 1477 |
| 230 | 332521.1 | 1457424 | 911 | 1464 |
| 231 | 245136.4 | 1459743 | 1513 | 1946 |
| 232 | 237485.3 | 1469028 | 20 | 638 |
| 233 | 350851.2 | 1478855 | 39 | 248 |
| 234 | 403794.3 | 1482166 | 284 | 598 |
| 235 | 227489.1 | 1487428 | 1087 | 1568 |

TABLE 3-continued

| SEQ ID NO | Template ID | Clone ID | Start | Stop |
|---|---|---|---|---|
| 236 | 268110.1 | 1495730 | 1 | 299 |
| 237 | 268244.1 | 1495907 | 1 | 592 |
| 238 | 268253.1 | 1495947 | 6 | 177 |
| 239 | 270049.1 | 1496011 | 58 | 414 |
| 240 | 997142.1 | 1496066 | 428 | 976 |
| 241 | 997080.1 | 1500810 | 882 | 2910 |
| 242 | 243369.1 | 1501410 | −6 | 273 |
| 243 | 379571.7 | 1501809 | 4670 | 5149 |
| 244 | 322303.15 | 1503162 | 3816 | 4344 |
| 245 | 232935.2 | 1506930 | 4559 | 5005 |
| 246 | 1445507CB1 | 1507302 | 2107 | 2804 |
| 248 | 69812.3 | 1511262 | 408 | 899 |
| 249 | 444648.12 | 1513566 | 1 | 691 |
| 250 | 25194.1 | 1515346 | 32 | 446 |
| 251 | 1518310CB1 | 1518310 | 1692 | 2154 |
| 253 | 241335.1 | 1520151 | 1453 | 1948 |
| 254 | 22651.1 | 1521272 | 252 | 754 |
| 255 | 25911.1 | 1547122 | 1945 | 2318 |
| 256 | 336470.1 | 1552522 | 1 | 266 |
| 257 | 978673.2 | 1559844 | 1781 | 2315 |
| 258 | 54242.1 | 1560380 | 132 | 681 |
| 259 | 1823159CB1 | 1560906 | 2628 | 3425 |
| 261 | 20602.1 | 1569904 | 15 | 244 |
| 262 | 1090531.28 | 1570534 | 1233 | 1653 |
| 263 | 399872.1 | 1571861 | 172 | 958 |
| 264 | 229176.4 | 1573840 | 320 | 691 |
| 265 | 229176.5 | 1573840 | 2542 | 2833 |
| 266 | 124600CB1 | 1578941 | 38 | 611 |
| 268 | 994387.65 | 1594179 | 2066 | 2480 |
| 269 | 201462.7 | 1596220 | 1 | 736 |
| 270 | 991497.1 | 1597837 | 19 | 834 |
| 271 | 347444.1 | 1600180 | 882 | 1548 |
| 272 | 238660.5 | 1604437 | 5456 | 5898 |
| 273 | 404601.1 | 1604650 | 1200 | 1721 |
| 274 | 1329936.3 | 1607203 | 1397 | 1747 |
| 275 | 370489.47 | 1609387 | 16 | 779 |
| 276 | 197185.2 | 1610828 | 1 | 477 |
| 277 | 1822864CB1 | 1611445 | 875 | 1602 |
| 279 | 2258794CB1 | 1611629 | 3054 | 3250 |
| 281 | 000506CB1 | 1614014 | 433 | 709 |
| 283 | 407263.1 | 1616048 | 372 | 852 |
| 284 | 1630551CB1 | 1619292 | 281 | 1147 |
| 286 | 2558815CB1 | 1630990 | 1846 | 2385 |
| 288 | 347411.1 | 1635877 | 1 | 627 |
| 289 | 92230.2 | 1636015 | 510 | 788 |
| 290 | 333989.1 | 1636594 | 130 | 807 |
| 291 | 333542.1 | 1637145 | 2020 | 2253 |
| 292 | 24262210CB1 | 1638756 | 500 | 992 |
| 294 | 476760.12 | 1651008 | 162 | 541 |
| 295 | 064987CB1 | 1652328 | 1913 | 2435 |
| 297 | 8450.1 | 1661892 | 1 | 291 |
| 298 | 197652.3 | 1662632 | 706 | 1521 |
| 299 | 248203.2 | 1662870 | 51 | 1084 |
| 300 | 2023351CB1 | 1667220 | 571 | 3240 |
| 302 | 228610.1 | 1670407 | 57 | 1117 |
| 303 | 92268.1 | 1679595 | 3215 | 3666 |
| 304 | 16566.1 | 1679683 | 39 | 264 |
| 305 | 1329120.1 | 1683583 | 1 | 452 |
| 306 | 898877.6 | 1684617 | 8435 | 8991 |
| 307 | 29490.1 | 1696552 | 1 | 501 |
| 308 | 2619838CB1 | 1697719 | 4334 | 5099 |
| 310 | 369213.42 | 1697855 | 534 | 969 |
| 311 | 3557818CB1 | 1700074 | 4590 | 5332 |
| 313 | 001622CB1 | 1700287 | 895 | 1741 |
| 315 | 223407.4 | 1706751 | 1061 | 1472 |
| 316 | 899334.1 | 1707037 | 3258 | 3537 |
| 317 | 237299.13 | 1709709 | 1 | 744 |
| 318 | 1149046.1 | 1715374 | 412 | 1220 |
| 319 | 404011.3 | 1716458 | 10 | 360 |
| 320 | 3768043CB1 | 1721320 | 2415 | 2852 |
| 322 | 39946.19 | 1721320 | 2312 | 2679 |
| 323 | 1723834CB1 | 1723834 | 2901 | 3240 |
| 325 | 2551987CB1 | 1728013 | 15 | 453 |
| 327 | 232772.13 | 1728013 | 649 | 890 |
| 328 | 407451.3 | 1730026 | 1482 | 1824 |
| 329 | 1382931.2 | 1732792 | 1486 | 1872 |
| 330 | 1382931.39 | 1732792 | 663 | 940 |
| 331 | 411059.1 | 1735702 | 146 | 697 |
| 332 | 474862.8 | 1737512 | 203 | 623 |
| 333 | 402366.1 | 1740179 | 566 | 1125 |
| 334 | 401532.3 | 1740474 | 1 | 509 |
| 335 | 401532.2 | 1740474 | 4392 | 4890 |
| 336 | 407896.4 | 1740788 | 1098 | 1629 |
| 337 | 982625.1 | 1740975 | 0 | 356 |
| 338 | 59947.1 | 1741288 | 470 | 1447 |
| 339 | 902471.11 | 1753283 | 1 | 420 |
| 340 | 442308.1 | 1756875 | 1 | 375 |
| 341 | 193755.1 | 1781411 | 2504 | 3043 |
| 342 | 60957.1 | 1786554 | 1 | 597 |
| 343 | 5124.23 | 1798594 | 36 | 297 |
| 344 | 344166.2 | 1799078 | 1684 | 2153 |
| 345 | 1129157.1 | 1802939 | 2433 | 2800 |
| 346 | 1804734CB1 | 1804553 | 607 | 1274 |
| 348 | 43646.7 | 1805836 | 572 | 1073 |
| 349 | 43646.1 | 1805836 | 1033 | 1371 |
| 350 | 4674640CB1 | 1807155 | 632 | 1058 |
| 352 | 25423.3 | 1816768 | 19 | 726 |
| 353 | 415378.3 | 1820105 | 3471 | 4512 |
| 354 | 25685.3 | 1820882 | 159 | 623 |
| 355 | 400427.1 | 1822143 | 1134 | 1866 |
| 356 | 198008.8 | 1823946 | 1852 | 2944 |
| 357 | 1825508CB1 | 1824860 | 432 | 751 |
| 359 | 236957.9 | 1831454 | 4 | 654 |
| 360 | 980807.1 | 1833010 | 1 | 189 |
| 361 | 1095192.1 | 1833362 | 1837 | 2274 |
| 362 | 167559.1 | 1834257 | 1229 | 1795 |
| 363 | 1383286.12 | 1840426 | 2007 | 3314 |
| 364 | 40790.1 | 1841901 | 1 | 288 |
| 365 | 53059.11 | 1848722 | 211 | 876 |
| 366 | 337156.2 | 1852354 | 3035 | 3311 |
| 367 | 349630.7 | 1853116 | 2224 | 2776 |
| 368 | 2125081CB1 | 1857044 | 2142 | 2865 |
| 370 | 1400574.1 | 1857664 | 379 | 946 |
| 371 | 994430.15 | 1857850 | 778 | 1397 |
| 372 | 2631218CB1 | 1868536 | 2302 | 2676 |
| 374 | 3688791CB1 | 1868738 | 71 | 524 |
| 376 | 3283554CB1 | 1872858 | 2130 | 2486 |
| 378 | 4960375CB1 | 1876456 | 1301 | 1755 |
| 380 | 222956.22 | 1876829 | 801 | 1075 |
| 381 | 222956.24 | 1876829 | 895 | 1061 |
| 382 | 973308.1 | 1886928 | 1603 | 2144 |
| 383 | 238026.4 | 1888260 | 1740 | 2592 |
| 384 | 1094829.52 | 1890576 | 1 | 458 |
| 385 | 1094829.54 | 1890576 | 837 | 2244 |
| 386 | 899802.1 | 1899766 | 1956 | 2619 |
| 387 | 107569.15 | 1900173 | 72 | 424 |
| 388 | 236605.2 | 1904987 | 531 | 966 |
| 389 | 2705321CB1 | 1905006 | 30 | 1573 |
| 391 | 383863.2 | 1909281 | 3461 | 3851 |
| 392 | 903491.4 | 1910401 | 1 | 721 |
| 393 | 332755.5 | 1911443 | 1236 | 2113 |
| 394 | 201694.5 | 1911819 | 35 | 573 |
| 395 | 65367.1 | 1913334 | 140 | 671 |
| 396 | 199140.9 | 1926934 | 250 | 756 |
| 397 | 1088542.9 | 1927771 | 1 | 689 |
| 398 | 233513.2 | 1930088 | 2165 | 2952 |
| 399 | 1330257.53 | 1930847 | 192 | 662 |
| 400 | 3676741CB1 | 1930847 | 1201 | 3140 |
| 402 | 346636.6 | 1942785 | 308 | 695 |
| 403 | 1640555CB1 | 1944123 | 487 | 1164 |
| 405 | 199286.3 | 1946155 | 1 | 449 |
| 406 | 199286.2 | 1946155 | 594 | 853 |
| 407 | 474200.1 | 1951845 | 1274 | 1615 |
| 91 | 1383290.2 | 1953051 | 857 | 1490 |
| 408 | 206397.1 | 1956982 | 1 | 237 |
| 409 | 199584.1 | 1960822 | 2715 | 3102 |
| 410 | 401736.1 | 1961617 | 175 | 775 |
| 411 | 1100773.2 | 1964758 | 152 | 437 |
| 412 | 167854.1 | 1965856 | 291 | 1113 |
| 413 | 1693903CB1 | 1973123 | 302 | 649 |
| 415 | 351432.23 | 1979363 | 1334 | 1804 |
| 416 | 1252096CB1 | 1979756 | 402 | 1172 |
| 418 | 2545475CB1 | 1981569 | 2829 | 3230 |
| 420 | 1756951CB1 | 1981929 | 1088 | 1566 |

TABLE 3-continued

| SEQ ID NO | Template ID | Clone ID | Start | Stop |
|---|---|---|---|---|
| 422 | 220134.6 | 1986919 | 2076 | 2609 |
| 423 | 220134.5 | 1986919 | 718 | 1125 |
| 424 | 202164.1 | 1988540 | 2781 | 3182 |
| 425 | 406846.4 | 1988593 | 17 | 1109 |
| 426 | 2716815CB1 | 1988774 | 2579 | 2941 |
| 428 | 222278.1 | 1995136 | 1945 | 2319 |
| 429 | 1273292CB1 | 1995520 | 2007 | 2428 |
| 431 | 67855.1 | 1995767 | 1 | 757 |
| 432 | 27185.1 | 1998317 | 1 | 492 |
| 433 | 240057.2 | 2005266 | 22 | 724 |
| 434 | 17090.1 | 2006043 | 60 | 379 |
| 435 | 17021.2 | 2007730 | 1 | 416 |
| 436 | 235682.5 | 2008331 | 1 | 531 |
| 437 | 399329.3 | 2009252 | 160 | 600 |
| 438 | 68862.1 | 2013251 | 1 | 362 |
| 439 | 8603.3 | 2013955 | 1 | 362 |
| 440 | 337647.1 | 2018315 | 181 | 927 |
| 441 | 200268.3 | 2018808 | 1584 | 2089 |
| 442 | 168861CB1 | 2019910 | 506 | 1002 |
| 444 | 334738.1 | 2021989 | 1 | 482 |
| 445 | 410042.1 | 2025128 | 526 | 1313 |
| 446 | 2026270CB1 | 2026270 | 532 | 800 |
| 448 | 522433CB1 | 2042056 | 854 | 1234 |
| 450 | 234987.1 | 2044184 | 1 | 427 |
| 451 | 1330257.32 | 2046717 | 1 | 372 |
| 452 | 407023.1 | 2047312 | 476 | 700 |
| 453 | 3117184CB1 | 2047730 | 401 | 806 |
| 455 | 3105671CB1 | 2051568 | 1812 | 2328 |
| 457 | 2051966CB1 | 2051966 | 45 | 1182 |
| 459 | 1969731CB1 | 2055569 | 700 | 2976 |
| 461 | 2171401CB1 | 2055814 | 854 | 1639 |
| 463 | 1326983.14 | 2055867 | 4036 | 4756 |
| 464 | 339106.1 | 2057265 | 1 | 393 |
| 465 | 331666.1 | 2057513 | 407 | 995 |
| 466 | 1422432CB1 | 2060823 | 397 | 842 |
| 468 | 409895.2 | 2060823 | 1224 | 1458 |
| 231 | 245136.4 | 2061171 | 1448 | 1936 |
| 469 | 245136.9 | 206117 | 1008 | 1454 |
| 470 | 2600262CB1 | 2061528 | 1954 | 2770 |
| 472 | 70246.1 | 2062085 | 17 | 69 |
| 473 | 1086183.1 | 2070126 | 76 | 951 |
| 474 | 900070.12 | 2078880 | 1555 | 1946 |
| 475 | 231182.1 | 2086783 | 344 | 1062 |
| 476 | 12417.1 | 2088104 | 1 | 332 |
| 477 | 237754.1 | 2089176 | 1 | 557 |
| 478 | 1256053CB1 | 2095144 | 657 | 1129 |
| 480 | 238391.3 | 2095268 | 595 | 1019 |
| 481 | 201945.4 | 2095329 | 1004 | 1489 |
| 482 | 235725.21 | 2095728 | 145 | 564 |
| 483 | 406031.5 | 2106010 | −20 | 917 |
| 484 | 998941.1 | 2110035 | 4192 | 4534 |
| 485 | 243985.1 | 2110103 | 1373 | 1795 |
| 486 | 481779.1 | 2110430 | 201 | 699 |
| 487 | 982633.1 | 2110482 | 378 | 1552 |
| 488 | 2120743CB1 | 2120743 | 716 | 1200 |
| 490 | 26914.1 | 2124056 | 1 | 206 |
| 491 | 199121.14 | 2131958 | 2585 | 2905 |
| 492 | 1960207CB1 | 2132606 | 38 | 558 |
| 494 | 391185.13 | 2132607 | 1565 | 2241 |
| 495 | 206866.1 | 2132784 | 1729 | 2157 |
| 496 | 1330257.51 | 2148703 | 721 | 1139 |
| 497 | 983942.1 | 2158661 | 1465 | 1704 |
| 498 | 223416.15 | 2158674 | 1 | 480 |
| 499 | 5876.1 | 2159706 | 1 | 605 |
| 500 | 303545.3 | 2169433 | 1 | 591 |
| 501 | 331571. | 2170820 | 1 | 384 |
| 502 | 2246292CB1 | 2173002 | 2817 | 3301 |
| 504 | 411449.1 | 2173973 | 3084 | 3594 |
| 505 | 409853.3 | 2174951 | 2060 | 2513 |
| 506 | 6301537CB1 | 2176212 | 2637 | 3047 |
| 508 | 1398801.9 | 2188005 | 414 | 894 |
| 509 | 1398801.5 | 2188005 | 1216 | 1408 |
| 510 | 14538.1 | 2189061 | 2 | 713 |
| 511 | 14007.1 | 2189237 | 1 | 327 |
| 512 | 239996.2 | 2195427 | 1 | 463 |
| 513 | 238403.2 | 2196870 | 676 | 1536 |
| 514 | 234681.2 | 2203570 | 1661 | 2186 |
| 515 | 228678.1 | 2215282 | 714 | 1428 |
| 516 | 233218.22 | 2216323 | 80 | 495 |
| 517 | 233218.18 | 2216323 | 2475 | 2663 |
| 518 | 6320.1 | 2222155 | 1 | 318 |
| 519 | 15433.1 | 2226309 | 1 | 370 |
| 520 | 1600311CB1 | 2227273 | 239 | 714 |
| 522 | 335999.1 | 2230608 | 426 | 1042 |
| 523 | 197523.6 | 2233219 | 898 | 1610 |
| 524 | 12833.1 | 2234266 | 1 | 239 |
| 525 | 1080598.1 | 2239236 | 925 | 1457 |
| 526 | 2239738CB1 | 2239738 | 1264 | 1909 |
| 528 | 87074.1 | 2246915 | 2235 | 2649 |
| 529 | 12039.1 | 2252501 | 1 | 270 |
| 530 | 1730175CB1 | 2252884 | 4816 | 5307 |
| 532 | 6825202CB1 | 2252906 | 344 | 1406 |
| 534 | 25613.1 | 2253102 | 2 | 526 |
| 535 | 3027821CB1 | 2253868 | 1053 | 1602 |
| 537 | 480736.41 | 2253868 | 1406 | 1769 |
| 538 | 236943.1 | 2260285 | 844 | 1253 |
| 539 | 76636.1 | 2266959 | 471 | 892 |
| 540 | 76644.1 | 2267466 | 355 | 721 |
| 541 | 76699.1 | 2268803 | 464 | 724 |
| 542 | 238140.1 | 2268923 | 15 | 233 |
| 543 | 19080.2 | 2269058 | 79 | 645 |
| 544 | 274444.1 | 2271648 | 1 | 483 |
| 545 | 279625.1 | 2273619 | 1 | 450 |
| 546 | 1330220.16 | 2273944 | 2433 | 3329 |
| 547 | 99792.1 | 2276895 | 1 | 708 |
| 548 | 5147.1 | 2277161 | 819 | 1283 |
| 549 | 272599.1 | 2278772 | 1 | 278 |
| 550 | 238396.1 | 2284694 | 434 | 1572 |
| 551 | 23904.1 | 2285181 | 113 | 960 |
| 552 | 274712.1 | 2285521 | 2235 | 2625 |
| 553 | 979567.1 | 2285721 | 6236 | 6729 |
| 554 | 234121.1 | 2286360 | 2237 | 2903 |
| 555 | 252493.15 | 2287426 | 3518 | 3961 |
| 556 | 899766.1 | 2287703 | 801 | 1255 |
| 557 | 247423.13 | 2287724 | 4420 | 4929 |
| 558 | 334234.2 | 2291665 | 1379 | 1798 |
| 559 | 205672.1 | 2293494 | 845 | 1666 |
| 560 | 1327024.5 | 2293496 | 7545 | 7927 |
| 561 | 2925789CB1 | 2294968 | 1387 | 2123 |
| 563 | 335613.1 | 2302785 | 1523 | 1926 |
| 564 | 207646.1 | 2302810 | 1 | 711 |
| 565 | 1720847CB1 | 2311213 | 241 | 930 |
| 567 | 2313349CB1 | 2313349 | 17 | 460 |
| 569 | 107939.2 | 2313581 | 2837 | 3302 |
| 570 | 11540.1 | 2314164 | 1 | 200 |
| 571 | 78831.1 | 2322243 | 371 | 601 |
| 572 | 207778.1 | 2325802 | 469 | 1185 |
| 573 | 296811.2 | 2327230 | 3077 | 3889 |
| 574 | 333776.1 | 2343348 | 126 | 201 |
| 575 | 1859458CB1 | 2343836 | 42 | 2003 |
| 577 | 110960CB1 | 2345426 | 94 | 980 |
| 579 | 238602.2 | 2346851 | 776 | 1266 |
| 580 | 363007.1 | 2347684 | 799 | 960 |
| 581 | 3478236CB1 | 2350594 | 72 | 623 |
| 583 | 2466714CB1 | 2358261 | 513 | 1431 |
| 585 | 4208.1 | 2364257 | 38 | 551 |
| 586 | 903475.2 | 2370756 | 1504 | 2029 |
| 587 | 246037.28 | 2372040 | 378 | 906 |
| 588 | 337183.1 | 2381040 | 403 | 1291 |
| 589 | 2651836CB1 | 2382190 | 1308 | 1775 |
| 591 | 80339.1 | 2383242 | 1 | 677 |
| 592 | 480968.13 | 2394616 | 861 | 1423 |
| 593 | 337448.1 | 2394990 | 650 | 957 |
| 594 | 5360.1 | 2395112 | 1 | 785 |
| 595 | 998599.8 | 2399169 | −8 | 488 |
| 596 | 332821.13 | 2399665 | 208 | 669 |
| 597 | 344186.9 | 2403438 | 1 | 395 |
| 598 | 344186.12 | 2403438 | 1066 | 1651 |
| 599 | 212489.1 | 2404746 | 948 | 1461 |
| 600 | 80711.1 | 2405487 | 25 | 363 |
| 601 | 80787.1 | 2407620 | 1 | 521 |
| 602 | 334352.1 | 2408333 | 963 | 1521 |
| 603 | 208376.1 | 2410066 | 1 | 563 |
| 604 | 7820.1 | 2415118 | 0 | 190 |

TABLE 3-continued

| SEQ ID NO | Template ID | Clone ID | Start | Stop |
|---|---|---|---|---|
| 605 | 81447.1 | 2420388 | 1 | 96 |
| 606 | 81821.1 | 2427327 | 1 | 311 |
| 607 | 81869.1 | 2428314 | 1 | 789 |
| 608 | 210011.1 | 2430165 | 1021 | 1368 |
| 609 | 480336.3 | 2430750 | 1 | 422 |
| 610 | 1024610.45 | 2444137 | 1139 | 1532 |
| 611 | 82013.1 | 2444740 | 1 | 703 |
| 612 | 212155.1 | 2445967 | 22 | 690 |
| 613 | 22632.1 | 2447829 | 393 | 830 |
| 614 | 2789525CB1 | 2453558 | 105 | 560 |
| 616 | 1692213CB1 | 2458526 | 13 | 435 |
| 618 | 15393.1 | 2459765 | 193 | 608 |
| 619 | 001089CB1 | 2469891 | 18 | 499 |
| 621 | 002484CB1 | 2471835 | 74 | 733 |
| 623 | 669671CB1 | 2482388 | 109 | 780 |
| 625 | 1344185CB1 | 2494284 | 1043 | 1581 |
| 627 | 697785CB1 | 2495131 | 21 | 332 |
| 629 | 336435.2 | 2497692 | 2047 | 2744 |
| 630 | 231558.1 | 2499418 | 342 | 1145 |
| 631 | 247784.3 | 2499905 | 116 | 1213 |
| 632 | 238322.6 | 2499976 | 2893 | 3642 |
| 633 | 55978.9 | 2500872 | 1 | 392 |
| 634 | 55978.4 | 2500872 | 2704 | 3145 |
| 635 | 350977.1 | 2506425 | 695 | 786 |
| 636 | 238877.11 | 2506973 | 244 | 579 |
| 637 | 238877.8 | 2506973 | −31 | 277 |
| 638 | 997231.15 | 2507552 | 1 | 520 |
| 639 | 997231.16 | 2507552 | 3 | 954 |
| 640 | 346209.3 | 2511277 | 4753 | 5180 |
| 641 | 2515666CB1 | 2515666 | 1 | 2321 |
| 643 | 2742913CB1 | 2516950 | 75 | 1693 |
| 645 | 336615.1 | 2520894 | 1088 | 1325 |
| 646 | 406830.43 | 2529162 | 639 | 986 |
| 647 | 406830.33 | 2529162 | 1 | 296 |
| 648 | 84685.1 | 2532033 | 8 | 309 |
| 649 | 1045907.4 | 2539933 | 1 | 375 |
| 650 | 1383803.2 | 2544622 | 312 | 611 |
| 651 | 85282.1 | 2545486 | 83 | 487 |
| 652 | 86326.1 | 2571644 | 749 | 1212 |
| 473 | 1086183.1 | 2579218 | 498 | 730 |
| 653 | 337470.1 | 2579572 | 1 | 1030 |
| 654 | 3721108CB1 | 2581075 | 976 | 1973 |
| 656 | 1090929.2 | 2607834 | 1080 | 1623 |
| 657 | 95374.1 | 2611889 | 63 | 777 |
| 658 | 238639.2 | 2619275 | 26 | 735 |
| 659 | 33627.28 | 2619954 | −37 | 288 |
| 660 | 33627.33 | 2619954 | 2260 | 2712 |
| 661 | 435361.1 | 2623304 | 916 | 1175 |
| 662 | 474552.1 | 2631261 | 1 | 448 |
| 663 | 2636759CB1 | 2636759 | 1 | 1130 |
| 665 | 1083665.4 | 2655279 | 241 | 1075 |
| 666 | 240518.21 | 2660756 | 1 | 333 |
| 667 | 240518.42 | 2660756 | 534 | 1026 |
| 668 | 1322.4 | 2663164 | 1069 | 3206 |
| 669 | 208282.1 | 2667438 | 117 | 1205 |
| 670 | 345272.5 | 2669337 | 1 | 330 |
| 671 | 345272.2 | 2669337 | 988 | 1436 |
| 672 | 997613.1 | 2669871 | 494 | 615 |
| 673 | 231840.1 | 2675433 | 394 | 1319 |
| 674 | 13937.3 | 2687356 | 19 | 613 |
| 675 | 253783.6 | 2695371 | 1 | 851 |
| 676 | 20828.1 | 2697275 | 89 | 264 |
| 677 | 222705.14 | 2698777 | −23 | 515 |
| 678 | 335906.1 | 2702786 | 1 | 369 |
| 679 | 1325741.2 | 2703122 | 1671 | 2046 |
| 680 | 2703282CB1 | 2703282 | 846 | 1314 |
| 682 | 118836.2 | 2705256 | 3522 | 4024 |
| 683 | 3303.2 | 2706669 | 4269 | 4611 |
| 684 | 92991.1 | 2707635 | 1 | 141 |
| 685 | 93603.1 | 2724032 | 1 | 75 |
| 686 | 1383062.7 | 2725369 | 17 | 291 |
| 687 | 1383062.8 | 2725369 | 10 | 563 |
| 688 | 1383794.1 | 2726759 | 34 | 528 |
| 689 | 406289.1 | 2734007 | −219 | 298 |
| 690 | 175918.15 | 2742315 | 5879 | 6351 |
| 691 | 1068290.1 | 2747179 | 850 | 1090 |
| 692 | 94873.1 | 2750849 | 1 | 395 |
| 693 | 403616.1 | 2751922 | 276 | 947 |
| 694 | 95088.1 | 2753065 | 1 | 618 |
| 695 | 230402.1 | 2753371 | 85 | 489 |
| 696 | 95172.1 | 2753963 | 1 | 802 |
| 697 | 250091.1 | 2755836 | 2 | 448 |
| 698 | 4113161CB1 | 2756333 | 1591 | 2131 |
| 700 | 335375.3 | 2756587 | 255 | 864 |
| 701 | 95395.1 | 2756747 | 1 | 570 |
| 702 | 229514.1 | 2756910 | 702 | 1294 |
| 703 | 95573.1 | 2759015 | 1 | 298 |
| 704 | 230463.1 | 2760615 | 528 | 1215 |
| 705 | 95702.1 | 2761527 | 1 | 360 |
| 706 | 218090.9 | 2767579 | 391 | 1543 |
| 707 | 96126.1 | 2769732 | 1 | 282 |
| 708 | 1508254CB1 | 2769888 | 1163 | 1589 |
| 710 | 207452CB1 | 2778441 | 70 | 1588 |
| 712 | 290233.1 | 2780013 | 1 | 272 |
| 713 | 1096917.11 | 2786442 | 1 | 506 |
| 714 | 208748.4 | 2794808 | 1913 | 2437 |
| 715 | 407517.2 | 2794866 | 4244 | 4978 |
| 716 | 233997.1 | 2797740 | 2639 | 3722 |
| 717 | 237067.1 | 2803833 | 67 | 624 |
| 718 | 330862.6 | 2806983 | 1 | 321 |
| 719 | 330862.8 | 2806983 | 1121 | 1754 |
| 720 | 2124957CB1 | 2811404 | 58 | 1860 |
| 722 | 1098722.6 | 2817244 | 1879 | 2470 |
| 723 | 1099023.1 | 2818476 | 174 | 554 |
| 724 | 201395.4 | 2822027 | 4780 | 5689 |
| 725 | 4295277CB1 | 2823478 | 7665 | 8240 |
| 727 | 98533.1 | 2823767 | 1 | 445 |
| 728 | 983684.1 | 2828647 | 318 | 804 |
| 729 | 983684.2 | 2828647 | 1 | 500 |
| 730 | 1837317CB1 | 2830240 | 820 | 1070 |
| 732 | 2937262CB1 | 2831351 | 57 | 523 |
| 734 | 199290.9 | 2833342 | 1 | 736 |
| 735 | 3151579CB1 | 2836470 | 3737 | 4135 |
| 737 | 235056.14 | 2836703 | 1 | 454 |
| 738 | 337939.2 | 2837006 | 1 | 355 |
| 739 | 208379.1 | 2838627 | 2388 | 2842 |
| 740 | 251631.6 | 2839946 | 13 | 387 |
| 741 | 2847188CB1 | 2847188 | 660 | 990 |
| 743 | 100579.1 | 2847867 | 1 | 363 |
| 744 | 1327498.1 | 2850323 | 1 | 468 |
| 745 | 1330212.14 | 2863211 | 35 | 507 |
| 746 | 252471.7 | 2864790 | 8 | 451 |
| 747 | 252471.4 | 2864790 | 893 | 1284 |
| 748 | 983536.1 | 2871076 | 26 | 371 |
| 749 | 983536.2 | 2871076 | −50 | 366 |
| 750 | 1330122.1 | 2874010 | 21793 | 22200 |
| 751 | 407468.1 | 2874881 | 323 | 1008 |
| 752 | 1330149.46 | 2880819 | 242 | 3096 |
| 753 | 32476.2 | 2881039 | 737 | 1596 |
| 754 | 1281694CB1 | 2886955 | 2036 | 2424 |
| 756 | 1719478CB1 | 2890141 | 1185 | 1478 |
| 758 | 230611.1 | 2891601 | 1 | 64 |
| 759 | 236749.1 | 2908212 | 1005 | 1705 |
| 760 | 407124.2 | 2908546 | 473 | 1412 |
| 761 | 104322.1 | 2908777 | 570 | 918 |
| 762 | 400253.14 | 2912637 | 238 | 1999 |
| 763 | 233595.17 | 2914439 | 1 | 739 |
| 764 | 978065.5 | 2915217 | 16 | 525 |
| 765 | 403642.1 | 2918279 | 1 | 429 |
| 766 | 984236.5 | 2925373 | 223 | 494 |
| 767 | 984236.1 | 2925373 | 410 | 857 |
| 768 | 1001589CB1 | 2927479 | 1840 | 2366 |
| 770 | 7808.1 | 2927486 | 494 | 1006 |
| 771 | 403627.38 | 2930673 | 87 | 385 |
| 772 | 106415.1 | 2933127 | 1 | 785 |
| 773 | 474622.1 | 2933175 | 86 | 856 |
| 774 | 1383009.57 | 2946292 | 24 | 555 |
| 775 | 1383009.67 | 2946292 | 216 | 809 |
| 776 | 1086355.2 | 2947188 | 11 | 416 |
| 777 | 1086355.1 | 2947188 | 80 | 667 |
| 778 | 998330.2 | 2948678 | 50 | 489 |
| 779 | 1384716.4 | 2954059 | 308 | 969 |
| 780 | 2790762CB1 | 2956444 | 435 | 994 |
| 782 | 399607.1 | 2956670 | 170 | 772 |

TABLE 3-continued

| SEQ ID NO | Template ID | Clone ID | Start | Stop |
|---|---|---|---|---|
| 783 | 256138.1 | 2956869 | −12 | 497 |
| 784 | 413348.4 | 2959255 | 1704 | 2129 |
| 785 | 332088.2 | 2972013 | 154 | 630 |
| 786 | 035282CB1 | 3001212 | 3 | 361 |
| 788 | 350667.7 | 3001212 | 381 | 782 |
| 789 | 343913.1 | 3001817 | 1 | 488 |
| 790 | 211622.1 | 3003980 | 1 | 701 |
| 791 | 110049.1 | 3016137 | 229 | 707 |
| 792 | 1806212CB1 | 3029474 | 765 | 1735 |
| 794 | 4436028CB1 | 3031022 | 782 | 1446 |
| 796 | 406663.3 | 3031872 | 142 | 736 |
| 797 | 405689.1 | 3034889 | 1 | 765 |
| 798 | 110815.1 | 3035780 | 1 | 215 |
| 799 | 1385527.4 | 3042227 | 2878 | 3410 |
| 800 | 2570.1 | 3045419 | 29 | 153 |
| 801 | 1100724.1 | 3045790 | 514 | 738 |
| 802 | 3704760CB1 | 3047143 | 36 | 595 |
| 804 | 344017.6 | 3049285 | 1605 | 2183 |
| 805 | 344017.3 | 3049285 | 1027 | 1623 |
| 806 | 2770104CB1 | 3057267 | 316 | 615 |
| 808 | 349204.1 | 3057272 | 1 | 934 |
| 114 | 1382924.38 | 3068429 | 553 | 964 |
| 809 | 2641740CB1 | 3068809 | 53 | 358 |
| 811 | 211881.1 | 3068978 | 1 | 548 |
| 812 | 334749.1 | 3069190 | 74 | 634 |
| 813 | 407838.1 | 3074113 | 234 | 997 |
| 814 | 170915CB1 | 3075994 | 614 | 885 |
| 816 | 994387.88 | 3084204 | 1 | 509 |
| 817 | 2454013CB1 | 3086833 | 239 | 1509 |
| 819 | 427967.6 | 3090808 | 1 | 515 |
| 820 | 427967.4 | 3090808 | 4566 | 5138 |
| 821 | 257016.1 | 3091135 | 39 | 539 |
| 822 | 215158.5 | 3097624 | 1 | 1107 |
| 823 | 522.12 | 3098189 | 1 | 435 |
| 824 | 522.1 | 3098189 | 216 | 440 |
| 825 | 113633.1 | 3098342 | 1 | 494 |
| 826 | 477387.3 | 3100048 | 1 | 439 |
| 827 | 477387.7 | 3100048 | 1253 | 1700 |
| 828 | 347796.7 | 3108506 | 395 | 687 |
| 829 | 2656429CB1 | 3115505 | 6 | 566 |
| 831 | 3346307CB1 | 3120209 | 12 | 1696 |
| 833 | 2649071CB1 | 3123530 | 458 | 905 |
| 835 | 1383086.2 | 3125211 | 481 | 1200 |
| 836 | 1850670CB1 | 3126622 | 115 | 2070 |
| 838 | 1132386.3 | 3135460 | 14 | 380 |
| 839 | 115052.1 | 3136307 | 1 | 576 |
| 840 | 1330056CB1 | 3139631 | 55 | 1484 |
| 842 | 199788.2 | 3141607 | 347 | 737 |
| 843 | 27881.1 | 3143494 | 513 | 866 |
| 844 | 234543.1 | 3144511 | 429 | 731 |
| 845 | 231547.2 | 3149570 | 1 | 553 |
| 846 | 399785.1 | 3158828 | 199 | 627 |
| 847 | 10498.24 | 3170010 | 3680 | 4421 |
| 848 | 399161.1 | 3172265 | 473 | 1121 |
| 849 | 241467.1 | 3187861 | 1 | 562 |
| 850 | 997194.1 | 3187903 | 1115 | 1563 |
| 851 | 17819.1 | 3188631 | 1052 | 1578 |
| 852 | 116536.1 | 3188860 | 652 | 1409 |
| 853 | 116549.1 | 3188967 | 1 | 465 |
| 854 | 17886.1 | 3190654 | 1 | 210 |
| 855 | 351032.1 | 3191030 | 238 | 844 |
| 856 | 977532.9 | 3200811 | 862 | 1536 |
| 857 | 117273.1 | 3206352 | 1 | 336 |
| 858 | 212438.1 | 3220149 | 606 | 830 |
| 859 | 212265.7 | 3221109 | 101 | 597 |
| 860 | 403560.1 | 3229449 | 129 | 810 |
| 861 | 1073168.6 | 3230318 | 386 | 656 |
| 862 | 1073168.8 | 3230318 | 3577 | 3819 |
| 863 | 119614.1 | 3253462 | 1 | 295 |
| 864 | 119625.1 | 3253556 | 135 | 356 |
| 865 | 119671.1 | 3253978 | 1 | 404 |
| 866 | 3177.1 | 3254430 | 260 | 1532 |
| 867 | 119974.1 | 3255873 | 1 | 295 |
| 868 | 120831.1 | 3278632 | 483 | 958 |
| 869 | 27619.3 | 3284411 | 474 | 1316 |
| 870 | 212872.1 | 3332232 | 31 | 507 |
| 871 | 404952.4 | 3334476 | 32 | 551 |
| 872 | 404952.1 | 3334476 | 3392 | 3982 |
| 873 | 125014.1 | 3369213 | 35 | 308 |
| 874 | 348390.2 | 3381870 | 50 | 205 |
| 875 | 227222.1 | 3390535 | −123 | 301 |
| 876 | 337696.1 | 3391835 | 1 | 117 |
| 877 | 253550.2 | 3397390 | 345 | 737 |
| 878 | 1326925.1 | 3408804 | 528 | 829 |
| 879 | 127140.1 | 3408939 | 1 | 725 |
| 880 | 127204.1 | 3409540 | 1 | 310 |
| 881 | 330925.1 | 3410101 | 303 | 845 |
| 882 | 403960.1 | 3411051 | 166 | 1032 |
| 883 | 20152.1 | 3421730 | 376 | 722 |
| 884 | 26200.1 | 3426776 | 1 | 388 |
| 885 | 399474.1 | 3434166 | 2739 | 3904 |
| 886 | 981037.1 | 3449615 | 468 | 1309 |
| 887 | 130502.1 | 3451296 | 1 | 799 |
| 888 | 5202390CB1 | 3451645 | 98 | 697 |
| 890 | 213447.4 | 3456829 | 142 | 484 |
| 891 | 250439.1 | 3474091 | 1 | 418 |
| 892 | 2743049CB1 | 3478570 | 500 | 934 |
| 894 | 256026.8 | 3478570 | 309 | 692 |
| 895 | 998930.1 | 3479268 | 16 | 990 |
| 896 | 981149.2 | 3481841 | 14 | 523 |
| 897 | 335420.1 | 3495173 | 1712 | 2684 |
| 898 | 1082203.1 | 3497137 | 524 | 1471 |
| 899 | 225420.1 | 3497231 | 1442 | 2116 |
| 900 | 236298.4 | 3508345 | 1448 | 1916 |
| 901 | 236298.2 | 3508345 | 572 | 928 |
| 902 | 982813.1 | 3522739 | 329 | 1013 |
| 903 | 154771.1 | 3528232 | 147 | 441 |
| 904 | 477054.1 | 3566383 | 553 | 1267 |
| 905 | 2966.1 | 3569151 | 86 | 376 |
| 906 | 136212.1 | 3571607 | 1 | 558 |
| 907 | 977975.1 | 3595618 | 118 | 1885 |
| 908 | 1505038CB1 | 3606046 | 2 | 1186 |
| 910 | 262830CB1 | 3606947 | 1 | 1737 |
| 912 | 3607580CB1 | 3607580 | 2034 | 2829 |
| 914 | 137742.1 | 3614283 | 1 | 304 |
| 915 | 1095839.1 | 3616233 | 2977 | 3842 |
| 916 | 205328.1 | 3621521 | 1 | 729 |
| 917 | 252649.14 | 3629043 | −383 | 263 |
| 918 | 221762.2 | 3633707 | 2 | 455 |
| 919 | 138205.1 | 3639747 | 131 | 487 |
| 920 | 331566.1 | 3659618 | 3517 | 3954 |
| 921 | 1384719.3 | 3679667 | 3030 | 3522 |
| 922 | 1330137.1 | 3681722 | 1 | 237 |
| 923 | 409962.1 | 3686411 | 1 | 477 |
| 924 | 481118.7 | 3686603 | 926 | 1412 |
| 925 | 481118.12 | 3686603 | 1276 | 1869 |
| 926 | 337528.4 | 3687607 | −49 | 1310 |
| 927 | 3687719CB1 | 3687719 | 328 | 1256 |
| 929 | 332299.1 | 3714088 | 1 | 836 |
| 930 | 1530186CB1 | 3715059 | 3278 | 4655 |
| 932 | 251809.1 | 3721985 | 1 | 285 |
| 933 | 334025.5 | 3724351 | 85 | 469 |
| 934 | 350134.1 | 3729593 | 1 | 701 |
| 935 | 16124.2 | 3732960 | 31 | 391 |
| 936 | 140468.1 | 3736815 | 1 | 500 |
| 937 | 3257507CB1 | 3747901 | 271 | 1392 |
| 939 | 1400580.1 | 3770530 | 356 | 633 |
| 940 | 481154.3 | 3778404 | 653 | 1655 |
| 941 | 346716.17 | 3792988 | 6197 | 6701 |
| 942 | 346716.21 | 3792988 | 413 | 1063 |
| 943 | 1384720.16 | 3818422 | 1 | 287 |
| 944 | 1505790CB1 | 3821432 | 1 | 1226 |
| 946 | 3876162CB1 | 3875135 | 803 | 1647 |
| 948 | 40576.1 | 3876612 | 575 | 1254 |
| 949 | 1040190.14 | 3880722 | 1024 | 1467 |
| 950 | 1328310.1 | 3890145 | 229 | 314 |
| 951 | 34297.1 | 3915205 | 1 | 707 |
| 952 | 145549.2 | 3926757 | 1 | 377 |
| 954 | 178799.1 | 3960194 | 1 | 782 |
| 955 | 214767.1 | 3967255 | 1 | 370 |
| 956 | 94384.1 | 3973687 | −8 | 564 |
| 957 | 2852561CB1 | 3973887 | 19 | 1854 |
| 959 | 337058.1 | 3974247 | 1770 | 2672 |
| 960 | 988704.25 | 3975209 | 2143 | 2589 |

TABLE 3-continued

| SEQ ID NO | Template ID | Clone ID | Start | Stop |
|---|---|---|---|---|
| 961 | 988704.26 | 3975209 | 714 | 1164 |
| 962 | 401906.2 | 3979665 | 1 | 412 |
| 963 | 154220.1 | 3980695 | 87 | 385 |
| 964 | 5371205CB1 | 3983862 | 3165 | 3636 |
| 966 | 147026.1 | 3999352 | 1 | 397 |
| 967 | 410776.1 | 4000614 | 311 | 794 |
| 968 | 335121.1 | 4002388 | 78 | 369 |
| 969 | 147379.1 | 4003219 | 1 | 115 |
| 970 | 147403.1 | 4003460 | 34 | 1028 |
| 971 | 1041063.1 | 4018288 | 108 | 506 |
| 972 | 1041063.5 | 4018288 | 108 | 506 |
| 973 | 230912.1 | 4021009 | 1 | 518 |
| 974 | 1089708.18 | 4070403 | 448 | 1006 |
| 975 | 1050390.1 | 4077648 | 1 | 486 |
| 976 | 088957CB1 | 4087621 | 1147 | 1611 |
| 978 | 220943.21 | 4089291 | 2931 | 3683 |
| 979 | 28005.14 | 4089755 | 356 | 833 |
| 980 | 980446.1 | 4091186 | 1 | 801 |
| 981 | 198827.1 | 4092112 | 90 | 1147 |
| 982 | 215112.1 | 4110976 | 1 | 522 |
| 983 | 977929.1 | 4112181 | 1192 | 1685 |
| 984 | 281447.2 | 4181663 | 38 | 609 |
| 985 | 346641.3 | 4195203 | 1047 | 1409 |
| 986 | 230793.3 | 4203937 | 1005 | 2173 |
| 987 | 431288.1 | 4208369 | 639 | 879 |
| 988 | 4215034CB1 | 4215034 | 3479 | 4183 |
| 990 | 150627.1 | 4221092 | 1 | 717 |
| 991 | 121731.1 | 4222957 | 0 | 512 |
| 992 | 259907.1 | 4223315 | 1 | 132 |
| 993 | 977727.13 | 4223734 | 0 | 558 |
| 994 | 5915.1 | 4228236 | 1 | 649 |
| 995 | 8835.1 | 4232507 | 122 | 372 |
| 996 | 242010.6 | 4246966 | 405 | 590 |
| 997 | 242684.1 | 4247396 | 29 | 461 |
| 998 | 335145.1 | 4247951 | 1099 | 1460 |
| 999 | 678004CB1 | 4248767 | 1260 | 1738 |
| 1001 | 92922.1 | 4249090 | 1 | 131 |
| 1002 | 411373.7 | 4251117 | 209 | 1047 |
| 1003 | 404715.1 | 4252768 | 1 | 526 |
| 1004 | 278831.1 | 4252872 | 1 | 456 |
| 1005 | 343924.8 | 4253663 | 2628 | 3110 |
| 1006 | 200977.1 | 4253809 | 277 | 690 |
| 1007 | 181818.3 | 4266051 | 1801 | 2186 |
| 1008 | 029251CB1 | 4284270 | 24 | 622 |
| 1010 | 335648.1 | 4284384 | 33 | 430 |
| 1011 | 331108.1 | 4286760 | 2385 | 2748 |
| 1012 | 333840.1 | 4287327 | 1166 | 1659 |
| 1013 | 334298.1 | 4288091 | 1 | 463 |
| 1014 | 344597.2 | 4289063 | 1 | 259 |
| 1015 | 1262593.2 | 4289557 | 1156 | 1510 |
| 1016 | 461375.2 | 4291619 | 1142 | 1613 |
| 1017 | 233660.2 | 4292488 | 1 | 386 |
| 1018 | 230179.3 | 4297813 | 586 | 897 |
| 1019 | 230179.7 | 4297813 | 1135 | 1582 |
| 1020 | 296245.1 | 4298848 | 93 | 557 |
| 1021 | 981208.1 | 4307290 | 1525 | 1964 |
| 1022 | 406580.1 | 4312603 | 2441 | 3006 |
| 1023 | 200051.1 | 4312860 | 1567 | 2036 |
| 1024 | 1197030.1 | 4334474 | 749 | 1144 |
| 1025 | 1197030.1 | 4334474 | 546 | 971 |
| 1026 | 158859.1 | 4339883 | 52 | 390 |
| 1027 | 229490.1 | 4340307 | 166 | 859 |
| 1028 | 4832672CB1 | 4373333 | 40 | 438 |
| 943 | 1384720.16 | 4377432 | 477 | 601 |
| 1030 | 339638.1 | 4402555 | 1 | 687 |
| 1031 | 480885.2 | 4403805 | 190 | 2066 |
| 1032 | 342074.1 | 4408943 | 1 | 487 |
| 1033 | 406992.1 | 4413637 | 1 | 922 |
| 1034 | 1852849CB1 | 4423361 | 2390 | 2951 |
| 1036 | 1132829.1 | 4464538 | 119 | 561 |
| 1037 | 339800.1 | 4505265 | 1 | 651 |
| 1038 | 1399492.1 | 4508879 | 444 | 1335 |
| 1039 | 13039.2 | 4535971 | 2706 | 3916 |
| 1040 | 399626.1 | 4543123 | 1 | 829 |
| 1041 | 365070.3 | 4549259 | 393 | 841 |
| 1042 | 365070.1 | 4549259 | 123 | 698 |
| 1043 | 1383263.1 | 4554722 | 6 | 353 |
| 1044 | 1383263.14 | 4554722 | 2248 | 2655 |
| 1045 | 406707.2 | 4587665 | 1 | 505 |
| 1046 | 406707.1 | 4587665 | 557 | 675 |
| 1047 | 1051954.7 | 4590473 | 171 | 649 |
| 1048 | 102564.1 | 4606503 | 1 | 413 |
| 1049 | 233312.1 | 4611240 | 385 | 1008 |
| 1050 | 335568.1 | 4630674 | 1115 | 1414 |
| 1051 | 407739.1 | 4631069 | 239 | 419 |
| 1052 | 272273.1 | 4695453 | 142 | 875 |
| 1053 | 399133.9 | 4698018 | 3030 | 3665 |
| 1054 | 246727.11 | 4715924 | 272 | 642 |
| 1055 | 246727.17 | 4715924 | 1249 | 1618 |
| 1056 | 230367.2 | 4717363 | 1173 | 1604 |
| 1057 | 1383039.18 | 4721130 | 71 | 536 |
| 1058 | 1383039.17 | 4721130 | 912 | 1136 |
| 1059 | 27704.2 | 4738532 | 1 | 391 |
| 1060 | 346900.1 | 4741591 | 1 | 562 |
| 1061 | 249813.1 | 4759669 | 61 | 446 |
| 1062 | 411357.1 | 4792726 | 3 | 277 |
| 1063 | 68902.1 | 4822285 | 315 | 898 |
| 1064 | 210133.1 | 4855265 | 1669 | 2303 |
| 1065 | 430665.1 | 4858420 | 5 | 242 |
| 1066 | 902525.1 | 4860060 | 280 | 977 |
| 1067 | 256841.1 | 4863677 | 209 | 785 |
| 1068 | 206344.1 | 4872725 | 270 | 937 |
| 1069 | 107309.1 | 4883207 | 509 | 1011 |
| 1070 | 1074024.1 | 4884214 | 445 | 726 |
| 1071 | 233218.7 | 4886605 | 302 | 976 |
| 1011 | 331108.1 | 4894508 | 13145 | 13506 |
| 1072 | 1092387.12 | 4896168 | 1 | 556 |
| 1073 | 1092387.11 | 4896168 | 5 | 542 |
| 1074 | 366463.1 | 4912315 | 212 | 563 |
| 1075 | 304409.1 | 4970829 | 1 | 381 |
| 1076 | 1382920.38 | 4978708 | 49 | 565 |
| 1077 | 342365.1 | 5004556 | 334 | 589 |
| 1078 | 399210.1 | 5024212 | −10 | 568 |
| 1079 | 1089210.1 | 5033671 | 34 | 1152 |
| 1080 | 444619.9 | 5038177 | 590 | 959 |
| 1081 | 312986.1 | 5038604 | 1 | 254 |
| 1082 | 462057.1 | 5044351 | 688 | 1106 |
| 1083 | 197902.12 | 5045593 | 85 | 502 |
| 1084 | 997394.4 | 5046235 | 866 | 1306 |
| 1085 | 2481150CB1 | 5047895 | 318 | 738 |
| 1087 | 8198.1 | 5076842 | 390 | 898 |
| 1088 | 72297.2 | 5089438 | 192 | 797 |
| 1089 | 994430.16 | 5091002 | 1 | 521 |
| 1090 | 189036.1 | 5094042 | −58 | 368 |
| 1091 | 221042.1 | 5098879 | 765 | 2032 |
| 1092 | 408398.1 | 5101167 | 544 | 921 |
| 1093 | 985369.1 | 5102731 | 360 | 1154 |
| 1094 | 328796.1 | 5102951 | 1 | 450 |
| 1095 | 58804.1 | 5106915 | 119 | 715 |
| 1096 | 3505463CB1 | 5109437 | 237 | 522 |
| 1098 | 197159.1 | 5115293 | 1 | 439 |
| 1099 | 369928.1 | 5138591 | 1 | 878 |
| 1100 | 413466.6 | 5166479 | 677 | 1170 |
| 1101 | 397295.1 | 5186846 | 1 | 559 |
| 1102 | 1330139.5 | 5198045 | 305 | 1096 |
| 959 | 337058.1 | 5206821 | 1308 | 2649 |
| 1103 | 977951.1 | 5207486 | 1481 | 2760 |
| 1104 | 347316.1 | 5208013 | 4639 | 5036 |
| 1105 | 150288.3 | 5262558 | 1 | 443 |
| 1106 | 2455.1 | 5266015 | 668 | 1133 |
| 1107 | 372647.1 | 5266376 | 81 | 792 |
| 1108 | 137710.1 | 5275515 | 1 | 659 |
| 1109 | 407644.1 | 5275693 | 3222 | 3571 |
| 1110 | 373516.1 | 5280239 | 827 | 1226 |
| 1111 | 241762.23 | 5281739 | 1190 | 1501 |
| 1112 | 1040914.1 | 5285915 | 28 | 521 |
| 1113 | 358492.1 | 5291215 | 369 | 1080 |
| 1114 | 243924.12 | 5291518 | 4 | 399 |
| 1115 | 243924.13 | 5291518 | 1027 | 1513 |
| 1116 | 208075.1 | 5293028 | 417 | 737 |
| 1117 | 168955.1 | 5321996 | −29 | 710 |
| 804 | 344017.6 | 5322365 | 721 | 1243 |
| 1118 | 428508.1 | 5323022 | 1 | 783 |
| 1119 | 418070.1 | 5325802 | 717 | 1342 |

TABLE 3-continued

| SEQ ID NO | Template ID | Clone ID | Start | Stop |
|---|---|---|---|---|
| 1120 | 403994.5 | 5326338 | 328 | 974 |
| 1121 | 336726.1 | 5326983 | 348 | 766 |
| 1122 | 337250.1 | 5372104 | 1 | 498 |
| 1123 | 410781.1 | 5374705 | 1296 | 1705 |
| 1124 | 347759.3 | 5397446 | 551 | 814 |
| 1125 | 1252060.4 | 5398701 | 133 | 216 |
| 1126 | 209279.1 | 5399371 | 2089 | 4658 |
| 1127 | 418391.2 | 5405691 | 1373 | 1729 |
| 1128 | 480630.21 | 5424122 | 1 | 293 |
| 1129 | 117799.1 | 5426158 | 432 | 777 |
| 1130 | 235194.15 | 5427710 | 357 | 682 |
| 1131 | 379400.1 | 5501676 | −2 | 301 |
| 560 | 1327024.5 | 5506170 | 393 | 898 |
| 1132 | 380433.1 | 5507406 | 83 | 281 |
| 1133 | 140122.22 | 5508135 | 1819 | 2042 |
| 1134 | 131931.1 | 5509134 | 1 | 367 |
| 1135 | 381058.1 | 5512044 | 201 | 717 |
| 1136 | 403136.1 | 5521873 | −1 | 162 |
| 1137 | 276647.1 | 5541828 | 1 | 434 |
| 1138 | 191631.1 | 5543385 | 1 | 303 |
| 1139 | 887619.26 | 5573549 | 536 | 1160 |
| 1140 | 980953.1 | 5690026 | 131 | 481 |
| 1141 | 389859.1 | 5700537 | −8 | 283 |
| 1142 | 217281.1 | 5859590 | 1 | 396 |
| 1143 | 32428.1 | 5867032 | 106 | 523 |

TABLE 4

| SEQ ID NO | Template ID | Start | Stop | Frame | Hit Type |
|---|---|---|---|---|---|
| 1 | 230040.1 | 482 | 553 | forward 2 | SP |
| 1 | 230040.1 | 68 | 166 | forward 2 | SP |
| 5 | 343861.16 | 1950 | 2036 | forward 3 | TM |
| 5 | 343861.16 | 284 | 346 | forward 2 | TM |
| 5 | 343861.16 | 2081 | 2131 | forward 2 | TM |
| 5 | 343861.16 | 2193 | 2249 | forward 3 | TM |
| 5 | 343861.16 | 940 | 993 | forward 1 | SP |
| 5 | 343861.16 | 284 | 340 | forward 2 | TM |
| 5 | 343861.16 | 952 | 999 | forward 1 | TM |
| 5 | 343861.16 | 934 | 1014 | forward 1 | TM |
| 5 | 343861.16 | 940 | 1005 | forward 1 | TM |
| 5 | 343861.16 | 952 | 1014 | forward 1 | TM |
| 5 | 343861.16 | 940 | 1014 | forward 1 | TM |
| 5 | 343861.16 | 940 | 1011 | forward 1 | SP |
| 5 | 343861.16 | 940 | 1020 | forward 1 | SP |
| 5 | 343861.16 | 940 | 996 | forward 1 | TM |
| 5 | 343861.16 | 940 | 999 | forward 1 | SP |
| 5 | 343861.16 | 940 | 1008 | forward 1 | SP |
| 7 | 3170236CD1 | 1 | 21 | | SP |
| 7 | 3170236CD1 | 1 | 23 | | SP |
| 7 | 3170236CD1 | 1 | 19 | | TM |
| 7 | 3170236CD1 | 1 | 17 | | SP |
| 7 | 3170236CD1 | 1 | 19 | | SP |
| 8 | 259805.54 | 157 | 225 | forward 1 | TM |
| 8 | 259805.54 | 318 | 368 | forward 3 | TM |
| 8 | 259805.54 | 356 | 412 | forward 2 | TM |
| 11 | 1016903.1 | 2165 | 2242 | forward 2 | TM |
| 11 | 1016903.1 | 1180 | 1233 | forward 1 | SP |
| 11 | 1016903.1 | 1180 | 1254 | forward 1 | SP |
| 11 | 1016903.1 | 1180 | 1272 | forward 1 | SP |
| 11 | 1016903.1 | 1180 | 1248 | forward 1 | SP |
| 12 | 65385.7 | 2972 | 3034 | forward 2 | TM |
| 12 | 65385.7 | 1615 | 1689 | forward 1 | TM |
| 12 | 65385.7 | 1609 | 1659 | forward 1 | TM |
| 15 | 1720920CD1 | 2220 | 2246 | | TM |
| 15 | 1720920CD1 | 2229 | 2246 | | SP |
| 15 | 1720920CD1 | 5 | 29 | | SP |
| 15 | 1720920CD1 | 2221 | 2245 | | TM |
| 15 | 1720920CD1 | 2229 | 2247 | | TM |
| 15 | 1720920CD1 | 2229 | 2245 | | TM |
| 15 | 1720920CD1 | 2222 | 2244 | | SP |
| 15 | 1720920CD1 | 2222 | 2248 | | SP |
| 15 | 1720920CD1 | 2222 | 2237 | | SP |
| 15 | 1720920CD1 | 2222 | 2245 | | SP |
| 15 | 1720920CD1 | 2222 | 2241 | | SP |
| 15 | 1720920CD1 | 1 | 30 | | SP |
| 19 | 2114865CD1 | 1 | 25 | | SP |
| 19 | 2114865CD1 | 4 | 18 | | SP |
| 19 | 2114865CD1 | 1 | 18 | | SP |
| 19 | 2114865CD1 | 1 | 20 | | SP |
| 19 | 2114865CD1 | 1 | 23 | | SP |
| 20 | 1383740.1 | 330 | 383 | forward 3 | TM |
| 20 | 1383740.1 | 354 | 413 | forward 3 | SP |
| 20 | 1383740.1 | 354 | 407 | forward 3 | SP |
| 20 | 1383740.1 | 304 | 408 | forward 1 | SP |
| 20 | 1383740.1 | 336 | 389 | forward 3 | TM |
| 24 | 216485.1 | 1088 | 1156 | forward 2 | TM |
| 26 | 1399930.1 | 1652 | 1711 | forward 2 | SP |
| 26 | 1399930.1 | 1652 | 1705 | forward 2 | SP |
| 26 | 1399930.1 | 1625 | 1702 | forward 2 | TM |
| 26 | 1399930.1 | 618 | 680 | forward 3 | TM |
| 26 | 1399930.1 | 1263 | 1331 | forward 3 | TM |
| 26 | 1399930.1 | 946 | 1011 | forward 1 | SP |
| 26 | 1399930.1 | 579 | 629 | forward 3 | TM |
| 26 | 1399930.1 | 1637 | 1699 | forward 2 | TM |
| 26 | 1399930.1 | 1619 | 1693 | forward 2 | TM |
| 26 | 1399930.1 | 1057 | 1116 | forward 1 | SP |
| 26 | 1399930.1 | 1652 | 1702 | forward 2 | TM |
| 26 | 1399930.1 | 1454 | 1513 | forward 2 | TM |
| 26 | 1399930.1 | 1665 | 1724 | forward 3 | TM |
| 26 | 1399930.1 | 1460 | 1513 | forward 2 | TM |
| 27 | 414171.33 | 2618 | 2701 | forward 2 | SP |
| 27 | 414171.33 | 2618 | 2689 | forward 2 | SP |
| 27 | 414171.33 | 2129 | 2203 | forward 2 | SP |
| 27 | 414171.33 | 2623 | 2682 | forward 1 | TM |
| 27 | 414171.33 | 1160 | 1279 | forward 2 | SP |
| 27 | 414171.33 | 2631 | 2687 | forward 3 | TM |
| 27 | 414171.33 | 2630 | 2689 | forward 2 | TM |
| 27 | 414171.33 | 2618 | 2677 | forward 2 | SP |
| 28 | 230895.1 | 740 | 820 | forward 2 | SP |
| 28 | 230895.1 | 647 | 700 | forward 2 | TM |
| 28 | 230895.1 | 749 | 814 | forward 2 | SP |
| 28 | 230895.1 | 749 | 820 | forward 2 | SP |
| 30 | 346663.6 | 237 | 287 | forward 3 | TM |
| 30 | 346663.6 | 225 | 287 | forward 3 | TM |
| 30 | 346663.6 | 225 | 290 | forward 3 | SP |
| 30 | 346663.6 | 225 | 281 | forward 3 | SP |
| 31 | 96422.1 | 151 | 228 | forward 1 | SP |
| 31 | 96422.1 | 255 | 308 | forward 3 | TM |
| 33 | 995839.2 | 140 | 202 | forward 2 | SP |
| 35 | 2517374CD1 | 1 | 34 | | SP |
| 35 | 2517374CD1 | 1 | 21 | | SP |
| 35 | 2517374CD1 | 1 | 24 | | SP |
| 35 | 2517374CD1 | 1 | 25 | | SP |
| 35 | 2517374CD1 | 1 | 18 | | SP |
| 37 | 1255456CD1 | 1 | 18 | | SP |
| 37 | 1255456CD1 | 5 | 20 | | SP |
| 37 | 1255456CD1 | 1 | 20 | | SP |
| 37 | 1255456CD1 | 1 | 22 | | SP |
| 37 | 1255456CD1 | 1 | 26 | | SP |
| 37 | 1255456CD1 | 1 | 24 | | SP |
| 38 | 3084.1 | 13 | 69 | forward 1 | SP |
| 41 | 533825CD1 | 1 | 18 | | SP |
| 41 | 533825CD1 | 1 | 15 | | SP |
| 43 | 985475.8 | 1409 | 1471 | forward 2 | SP |
| 45 | 1382869.18 | 1352 | 1405 | forward 2 | SP |
| 45 | 1382869.18 | 1352 | 1417 | forward 2 | SP |
| 45 | 1382869.18 | 1352 | 1411 | forward 2 | SP |
| 45 | 1382869.18 | 1352 | 1423 | forward 2 | SP |
| 46 | 1382869.1 | 1549 | 1602 | forward 1 | SP |
| 46 | 1382869.1 | 1157 | 1216 | forward 2 | TM |
| 46 | 1382869.1 | 1549 | 1614 | forward 1 | SP |
| 46 | 1382869.1 | 1549 | 1608 | forward 1 | SP |
| 46 | 1382869.1 | 1172 | 1231 | forward 2 | SP |
| 46 | 1382869.1 | 1549 | 1620 | forward 1 | SP |
| 48 | 215990.2 | 3227 | 3301 | forward 2 | SP |
| 48 | 215990.2 | 4238 | 4306 | forward 2 | SP |
| 48 | 215990.2 | 2866 | 2949 | forward 1 | SP |
| 48 | 215990.2 | 2015 | 2071 | forward 2 | SP |
| 48 | 215990.2 | 2015 | 2077 | forward 2 | SP |
| 48 | 215990.2 | 2120 | 2173 | forward 2 | SP |

TABLE 4-continued

| SEQ ID NO | Template ID | Start | Stop | Frame | Hit Type |
|---|---|---|---|---|---|
| 48 | 215990.2 | 3507 | 3563 | forward 3 | TM |
| 48 | 215990.2 | 2120 | 2182 | forward 2 | SP |
| 48 | 215990.2 | 2015 | 2083 | forward 2 | SP |
| 49 | 428335.59 | 1518 | 1577 | forward 3 | SP |
| 54 | 404028.1 | 159 | 239 | forward 3 | TM |
| 55 | 996427.2 | 99 | 149 | forward 3 | TM |
| 55 | 996427.2 | 2224 | 2274 | forward 1 | TM |
| 56 | 21971.1 | 161 | 220 | forward 2 | SP |
| 58 | 400650.3 | 259 | 324 | forward 1 | SP |
| 59 | 344524.1 | 2422 | 2481 | forward 1 | TM |
| 59 | 344524.1 | 2563 | 2616 | forward 1 | SP |
| 59 | 344524.1 | 1737 | 1799 | forward 3 | SP |
| 59 | 344524.1 | 1737 | 1790 | forward 3 | SP |
| 59 | 344524.1 | 1957 | 2007 | forward 1 | TM |
| 59 | 344524.1 | 3170 | 3238 | forward 2 | SP |
| 59 | 344524.1 | 2900 | 2971 | forward 2 | TM |
| 59 | 344524.1 | 3508 | 3570 | forward 1 | TM |
| 59 | 344524.1 | 1363 | 1449 | forward 1 | SP |
| 59 | 344524.1 | 2563 | 2613 | forward 1 | SP |
| 60 | 196709.1 | 366 | 434 | forward 3 | TM |
| 60 | 196709.1 | 381 | 458 | forward 3 | TM |
| 60 | 196709.1 | 378 | 440 | forward 3 | TM |
| 60 | 196709.1 | 378 | 434 | forward 3 | TM |
| 61 | 37502.4 | 3618 | 3692 | forward 3 | SP |
| 61 | 37502.4 | 5525 | 5587 | forward 2 | TM |
| 61 | 37502.4 | 1908 | 1964 | forward 3 | SP |
| 61 | 37502.4 | 1143 | 1205 | forward 3 | SP |
| 61 | 37502.4 | 2606 | 2674 | forward 2 | TM |
| 61 | 37502.4 | 6032 | 6088 | forward 2 | TM |
| 61 | 37502.4 | 5759 | 5809 | forward 2 | SP |
| 61 | 37502.4 | 338 | 400 | forward 2 | SP |
| 61 | 37502.4 | 5516 | 5587 | forward 2 | TM |
| 61 | 37502.4 | 5551 | 5604 | forward 1 | SP |
| 61 | 37502.4 | 1735 | 1815 | forward 1 | SP |
| 61 | 37502.4 | 5045 | 5155 | forward 2 | SP |
| 61 | 37502.4 | 3627 | 3677 | forward 3 | TM |
| 61 | 37502.4 | 353 | 400 | forward 2 | SP |
| 61 | 37502.4 | 335 | 421 | forward 2 | SP |
| 61 | 37502.4 | 329 | 403 | forward 2 | SP |
| 64 | 085596CD1 | 1 | 22 |  | SP |
| 64 | 085596CD1 | 1 | 21 |  | SP |
| 64 | 085596CD1 | 1 | 16 |  | SP |
| 64 | 085596CD1 | 1 | 24 |  | SP |
| 64 | 085596CD1 | 1 | 18 |  | SP |
| 68 | 978439.4 | 2571 | 2636 | forward 3 | SP |
| 68 | 978439.4 | 4666 | 4713 | forward 1 | TM |
| 68 | 978439.4 | 1008 | 1067 | forward 3 | TM |
| 68 | 978439.4 | 5694 | 5756 | forward 3 | TM |
| 68 | 978439.4 | 2318 | 2386 | forward 2 | TM |
| 68 | 978439.4 | 1102 | 1158 | forward 1 | SP |
| 68 | 978439.4 | 3745 | 3798 | forward 1 | TM |
| 68 | 978439.4 | 3730 | 3789 | forward 1 | SP |
| 68 | 978439.4 | 1117 | 1173 | forward 1 | TM |
| 68 | 978439.4 | 4360 | 4416 | forward 1 | TM |
| 72 | 1256895CD1 | 234 | 251 |  | TM |
| 72 | 1256895CD1 | 109 | 126 |  | SP |
| 72 | 1256895CD1 | 1 | 22 |  | SP |
| 72 | 1256895CD1 | 1 | 20 |  | SP |
| 72 | 1256895CD1 | 232 | 253 |  | SP |
| 74 | 291267.1 | 833 | 898 | forward 2 | SP |
| 74 | 291267.1 | 2145 | 2198 | forward 3 | SP |
| 74 | 291267.1 | 2172 | 2246 | forward 3 | TM |
| 74 | 291267.1 | 219 | 272 | forward 3 | TM |
| 74 | 291267.1 | 210 | 266 | forward 3 | TM |
| 74 | 291267.1 | 833 | 895 | forward 2 | SP |
| 74 | 291267.1 | 207 | 275 | forward 3 | TM |
| 74 | 291267.1 | 2160 | 2219 | forward 3 | TM |
| 74 | 291267.1 | 210 | 272 | forward 3 | TM |
| 74 | 291267.1 | 2148 | 2219 | forward 3 | TM |
| 74 | 291267.1 | 833 | 880 | forward 2 | SP |
| 74 | 291267.1 | 201 | 275 | forward 3 | TM |
| 78 | 980593.6 | 663 | 734 | forward 3 | TM |
| 78 | 980593.6 | 944 | 1021 | forward 2 | TM |
| 80 | 405773.2 | 1842 | 1943 | forward 3 | SP |
| 82 | 20265.2 | 64 | 117 | forward 1 | TM |
| 85 | 088564CD1 | 1 | 26 |  | SP |
| 85 | 088564CD1 | 1 | 26 |  | SP |
| 85 | 088564CD1 | 1 | 22 |  | SP |
| 88 | 212533.1 | 885 | 935 | forward 3 | TM |
| 88 | 212533.1 | 864 | 938 | forward 3 | SP |
| 88 | 212533.1 | 864 | 953 | forward 3 | SP |
| 88 | 212533.1 | 897 | 959 | forward 3 | TM |
| 90 | 983961.1 | 336 | 386 | forward 3 | TM |
| 90 | 983961.1 | 330 | 389 | forward 3 | TM |
| 91 | 1383290.2 | 1197 | 1259 | forward 3 | SP |
| 91 | 1383290.2 | 826 | 879 | forward 1 | TM |
| 91 | 1383290.2 | 1239 | 1301 | forward 3 | TM |
| 92 | 337221.11 | 1631 | 1717 | forward 2 | SP |
| 93 | 290344.1 | 3833 | 3904 | forward 2 | TM |
| 93 | 290344.1 | 1972 | 2025 | forward 1 | SP |
| 93 | 290344.1 | 1307 | 1384 | forward 2 | SP |
| 94 | 290344.3 | 623 | 685 | forward 2 | TM |
| 97 | 34424.1 | 221 | 289 | forward 2 | SP |
| 99 | 272843.14 | 1899 | 1961 | forward 3 | SP |
| 99 | 272843.14 | 4232 | 4303 | forward 2 | SP |
| 99 | 272843.14 | 1276 | 1371 | forward 1 | SP |
| 99 | 272843.14 | 1899 | 1955 | forward 3 | TM |
| 99 | 272843.14 | 6588 | 6674 | forward 3 | SP |
| 99 | 272843.14 | 1881 | 1961 | forward 3 | SP |
| 99 | 272843.14 | 1899 | 1961 | forward 3 | TM |
| 99 | 272843.14 | 4462 | 4548 | forward 1 | SP |
| 99 | 272843.14 | 6648 | 6719 | forward 3 | SP |
| 99 | 272843.14 | 1701 | 1763 | forward 3 | SP |
| 99 | 272843.14 | 4232 | 4285 | forward 2 | SP |
| 99 | 272843.14 | 2761 | 2844 | forward 1 | SP |
| 99 | 272843.14 | 1701 | 1772 | forward 3 | SP |
| 99 | 272843.14 | 5008 | 5064 | forward 1 | TM |
| 99 | 272843.14 | 4232 | 4294 | forward 2 | SP |
| 99 | 272843.14 | 1899 | 1958 | forward 3 | TM |
| 99 | 272843.14 | 1908 | 1958 | forward 3 | TM |
| 99 | 272843.14 | 5008 | 5070 | forward 1 | TM |
| 99 | 272843.14 | 1701 | 1772 | forward 3 | SP |
| 99 | 272843.14 | 1701 | 1781 | forward 3 | SP |
| 99 | 272843.14 | 5008 | 5061 | forward 1 | TM |
| 99 | 272843.14 | 4232 | 4285 | forward 2 | SP |
| 100 | 234729.3 | 547 | 606 | forward 1 | SP |
| 100 | 234729.3 | 6397 | 6456 | forward 1 | TM |
| 100 | 234729.3 | 5821 | 5898 | forward 1 | SP |
| 100 | 234729.3 | 5866 | 5913 | forward 1 | SP |
| 100 | 234729.3 | 6351 | 6407 | forward 3 | TM |
| 100 | 234729.3 | 5857 | 5916 | forward 1 | SP |
| 100 | 234729.3 | 5866 | 5922 | forward 1 | SP |
| 100 | 234729.3 | 5848 | 5916 | forward 1 | SP |
| 100 | 234729.3 | 5848 | 5913 | forward 1 | TM |
| 100 | 234729.3 | 5860 | 5913 | forward 1 | TM |
| 100 | 234729.3 | 5848 | 5910 | forward 1 | TM |
| 100 | 234729.3 | 5830 | 5919 | forward 1 | TM |
| 100 | 234729.3 | 5821 | 5910 | forward 1 | SP |
| 100 | 234729.3 | 5860 | 5919 | forward 1 | TM |
| 100 | 234729.3 | 5845 | 5916 | forward 1 | TM |
| 101 | 349647.1 | 340 | 396 | forward 1 | TM |
| 103 | 230193.1 | 1108 | 1164 | forward 1 | SP |
| 103 | 230193.1 | 572 | 628 | forward 2 | TM |
| 103 | 230193.1 | 1264 | 1311 | forward 1 | TM |
| 104 | 213429.1 | 45 | 107 | forward 3 | TM |
| 107 | 903909.1 | 879 | 932 | forward 3 | TM |
| 108 | 196981.1 | 841 | 906 | forward 1 | SP |
| 108 | 196981.1 | 720 | 785 | forward 3 | SP |
| 108 | 196981.1 | 744 | 797 | forward 3 | TM |
| 108 | 196981.1 | 720 | 791 | forward 3 | TM |
| 108 | 196981.1 | 369 | 419 | forward 3 | SP |
| 108 | 196981.1 | 457 | 513 | forward 1 | TM |
| 108 | 196981.1 | 738 | 800 | forward 3 | TM |
| 108 | 196981.1 | 451 | 507 | forward 1 | TM |
| 108 | 196981.1 | 741 | 797 | forward 3 | TM |
| 109 | 337888.3 | 1814 | 1870 | forward 2 | TM |
| 109 | 337888.3 | 1089 | 1166 | forward 3 | TM |
| 109 | 337888.3 | 1310 | 1384 | forward 2 | SP |
| 109 | 337888.3 | 1659 | 1712 | forward 3 | TM |
| 109 | 337888.3 | 1818 | 1886 | forward 3 | SP |
| 109 | 337888.3 | 1650 | 1706 | forward 3 | TM |
| 113 | 20525.1 | 167 | 244 | forward 2 | SP |
| 113 | 20525.1 | 167 | 226 | forward 2 | SP |
| 114 | 1382924.38 | 2550 | 2597 | forward 3 | SP |

TABLE 4-continued

| SEQ ID NO | Template ID | Start | Stop | Frame | Hit Type |
|---|---|---|---|---|---|
| 114 | 1382924.38 | 3280 | 3339 | forward 1 | TM |
| 114 | 1382924.38 | 2550 | 2624 | forward 3 | SP |
| 114 | 1382924.38 | 2550 | 2603 | forward 3 | TM |
| 114 | 1382924.38 | 4067 | 4120 | forward 2 | TM |
| 114 | 1382924.38 | 4228 | 4290 | forward 1 | SP |
| 114 | 1382924.38 | 2550 | 2615 | forward 3 | SP |
| 114 | 1382924.38 | 1552 | 1617 | forward 1 | TM |
| 114 | 1382924.38 | 4228 | 4290 | forward 1 | TM |
| 114 | 1382924.38 | 4207 | 4284 | forward 1 | TM |
| 114 | 1382924.38 | 1402 | 1485 | forward 1 | TM |
| 114 | 1382924.38 | 4067 | 4123 | forward 2 | TM |
| 117 | 247185.1 | 436 | 486 | forward 1 | TM |
| 117 | 247185.1 | 448 | 531 | forward 1 | TM |
| 118 | 197587.3 | 2277 | 2342 | forward 3 | SP |
| 118 | 197587.3 | 2277 | 2333 | forward 3 | SP |
| 118 | 197587.3 | 1819 | 1893 | forward 1 | TM |
| 118 | 197587.3 | 2277 | 2354 | forward 3 | SP |
| 118 | 197587.3 | 2198 | 2248 | forward 2 | TM |
| 118 | 197587.3 | 3424 | 3477 | forward 1 | TM |
| 118 | 197587.3 | 2277 | 2354 | forward 3 | SP |
| 119 | 403872.1 | 1153 | 1215 | forward 1 | TM |
| 119 | 403872.1 | 418 | 480 | forward 1 | TM |
| 119 | 403872.1 | 2105 | 2176 | forward 2 | TM |
| 119 | 403872.1 | 598 | 651 | forward 1 | TM |
| 119 | 403872.1 | 1517 | 1570 | forward 2 | SP |
| 119 | 403872.1 | 1517 | 1579 | forward 2 | SP |
| 119 | 403872.1 | 1514 | 1570 | forward 2 | TM |
| 119 | 403872.1 | 415 | 486 | forward 1 | TM |
| 119 | 403872.1 | 418 | 489 | forward 1 | TM |
| 120 | 900993.1 | 47 | 109 | forward 2 | TM |
| 120 | 900993.1 | 299 | 352 | forward 2 | TM |
| 120 | 900993.1 | 296 | 352 | forward 2 | TM |
| 120 | 900993.1 | 661 | 729 | forward 1 | SP |
| 120 | 900993.1 | 661 | 723 | forward 1 | SP |
| 120 | 900993.1 | 296 | 358 | forward 2 | TM |
| 120 | 900993.1 | 605 | 658 | forward 2 | TM |
| 120 | 900993.1 | 646 | 702 | forward 1 | TM |
| 120 | 900993.1 | 661 | 717 | forward 1 | SP |
| 121 | 228511.1 | 1098 | 1163 | forward 3 | SP |
| 121 | 228511.1 | 3939 | 3992 | forward 3 | TM |
| 121 | 228511.1 | 3996 | 4046 | forward 3 | TM |
| 121 | 228511.1 | 3958 | 4014 | forward 1 | TM |
| 121 | 228511.1 | 4589 | 4666 | forward 2 | TM |
| 121 | 228511.1 | 3713 | 3769 | forward 2 | TM |
| 121 | 228511.1 | 3993 | 4049 | forward 3 | TM |
| 121 | 228511.1 | 1803 | 1886 | forward 3 | TM |
| 121 | 228511.1 | 3700 | 3759 | forward 1 | TM |
| 124 | 291155.1 | 540 | 596 | forward 3 | SP |
| 125 | 1383047.1 | 1994 | 2056 | forward 2 | SP |
| 125 | 1383047.1 | 343 | 405 | forward 1 | TM |
| 125 | 1383047.1 | 1988 | 2047 | forward 2 | TM |
| 125 | 1383047.1 | 521 | 592 | forward 2 | TM |
| 125 | 1383047.1 | 1994 | 2044 | forward 2 | TM |
| 129 | 216141.1 | 45 | 110 | forward 3 | TM |
| 129 | 216141.1 | 8 | 79 | forward 2 | TM |
| 129 | 216141.1 | 122 | 190 | forward 2 | SP |
| 129 | 216141.1 | 26 | 85 | forward 2 | TM |
| 129 | 216141.1 | 13 | 72 | forward 1 | TM |
| 129 | 216141.1 | 10 | 81 | forward 1 | TM |
| 131 | 408751.3 | 2411 | 2467 | forward 2 | TM |
| 131 | 408751.3 | 2012 | 2092 | forward 2 | SP |
| 132 | 998310.1 | 187 | 252 | forward 1 | SP |
| 133 | 1097471.1 | 216 | 293 | forward 3 | SP |
| 134 | 983843.2 | 175 | 237 | forward 1 | TM |
| 135 | 983843.1 | 236 | 310 | forward 2 | TM |
| 136 | 985607.8 | 3006 | 3059 | forward 3 | TM |
| 136 | 985607.8 | 2955 | 3011 | forward 3 | TM |
| 136 | 985607.8 | 4295 | 4363 | forward 2 | SP |
| 136 | 985607.8 | 4313 | 4363 | forward 2 | TM |
| 136 | 985607.8 | 4277 | 4348 | forward 2 | SP |
| 136 | 985607.8 | 2970 | 3023 | forward 3 | SP |
| 136 | 985607.8 | 4843 | 4902 | forward 1 | TM |
| 136 | 985607.8 | 4295 | 4381 | forward 2 | SP |
| 137 | 152298.2 | 364 | 420 | forward 1 | SP |
| 137 | 152298.2 | 355 | 405 | forward 1 | TM |
| 137 | 152298.2 | 346 | 420 | forward 1 | SP |
| 137 | 152298.2 | 355 | 420 | forward 1 | SP |
| 137 | 152298.2 | 339 | 398 | forward 3 | SP |
| 137 | 152298.2 | 365 | 418 | forward 2 | TM |
| 137 | 152298.2 | 339 | 422 | forward 3 | SP |
| 137 | 152298.2 | 339 | 392 | forward 3 | TM |
| 137 | 152298.2 | 339 | 395 | forward 3 | SP |
| 137 | 152298.2 | 339 | 410 | forward 3 | SP |
| 137 | 152298.2 | 339 | 407 | forward 3 | SP |
| 138 | 246336.2 | 823 | 894 | forward 1 | SP |
| 138 | 246336.2 | 1327 | 1377 | forward 1 | TM |
| 139 | 246336.18 | 449 | 508 | forward 2 | TM |
| 139 | 246336.18 | 1334 | 1390 | forward 2 | TM |
| 139 | 246336.18 | 1245 | 1295 | forward 3 | TM |
| 139 | 246336.18 | 1325 | 1387 | forward 2 | TM |
| 139 | 246336.18 | 437 | 493 | forward 2 | SP |
| 141 | 253855.2 | 3745 | 3798 | forward 1 | TM |
| 141 | 253855.2 | 997 | 1047 | forward 1 | SP |
| 141 | 253855.2 | 3698 | 3757 | forward 2 | SP |
| 141 | 253855.2 | 3725 | 3787 | forward 2 | TM |
| 141 | 253855.2 | 4597 | 4665 | forward 1 | SP |
| 141 | 253855.2 | 2880 | 2954 | forward 3 | TM |
| 141 | 253855.2 | 4597 | 4656 | forward 1 | SP |
| 141 | 253855.2 | 4585 | 4641 | forward 1 | TM |
| 141 | 253855.2 | 3716 | 3775 | forward 2 | TM |
| 142 | 337187.1 | 951 | 1004 | forward 3 | TM |
| 142 | 337187.1 | 421 | 489 | forward 1 | SP |
| 142 | 337187.1 | 421 | 504 | forward 1 | SP |
| 144 | 932244CD1 | 302 | 320 | | SP |
| 144 | 932244CD1 | 302 | 316 | | SP |
| 144 | 932244CD1 | 302 | 323 | | SP |
| 144 | 932244CD1 | 1 | 18 | | SP |
| 144 | 932244CD1 | 302 | 324 | | TM |
| 144 | 932244CD1 | 302 | 323 | | TM |
| 144 | 932244CD1 | 1 | 21 | | SP |
| 144 | 932244CD1 | 302 | 322 | | SP |
| 144 | 932244CD1 | 305 | 321 | | TM |
| 144 | 932244CD1 | 305 | 323 | | TM |
| 144 | 932244CD1 | 302 | 322 | | TM |
| 144 | 932244CD1 | 1 | 19 | | SP |
| 146 | 13343.1 | 414 | 461 | forward 3 | SP |
| 146 | 13343.1 | 414 | 479 | forward 3 | SP |
| 147 | 399488.4 | 689 | 751 | forward 2 | SP |
| 147 | 399488.4 | 974 | 1039 | forward 2 | SP |
| 147 | 399488.4 | 1370 | 1426 | forward 2 | SP |
| 147 | 399488.4 | 1370 | 1414 | forward 2 | SP |
| 147 | 399488.4 | 689 | 763 | forward 2 | SP |
| 151 | 237622.6 | 1548 | 1625 | forward 3 | TM |
| 151 | 237622.6 | 1071 | 1121 | forward 3 | TM |
| 154 | 162569.1 | 353 | 427 | forward 2 | TM |
| 155 | 334116.1 | 4159 | 4218 | forward 1 | SP |
| 155 | 334116.1 | 3289 | 3342 | forward 1 | TM |
| 155 | 334116.1 | 3574 | 3630 | forward 1 | TM |
| 155 | 334116.1 | 4189 | 4245 | forward 1 | TM |
| 155 | 334116.1 | 4213 | 4266 | forward 1 | SP |
| 155 | 334116.1 | 4008 | 4055 | forward 3 | TM |
| 155 | 334116.1 | 4159 | 4233 | forward 1 | SP |
| 155 | 334116.1 | 4159 | 4227 | forward 1 | SP |
| 156 | 396837.1 | 1169 | 1213 | forward 1 | SP |
| 156 | 396837.1 | 1497 | 1568 | forward 3 | SP |
| 157 | 406507.1 | 50 | 112 | forward 2 | SP |
| 157 | 406507.1 | 98 | 175 | forward 2 | TM |
| 158 | 407612.1 | 1381 | 1443 | forward 2 | TM |
| 158 | 407612.1 | 316 | 390 | forward 1 | TM |
| 158 | 407612.1 | 3107 | 3157 | forward 2 | TM |
| 158 | 407612.1 | 403 | 462 | forward 1 | SP |
| 158 | 407612.1 | 199 | 273 | forward 1 | SP |
| 158 | 407612.1 | 458 | 535 | forward 2 | SP |
| 158 | 407612.1 | 403 | 474 | forward 1 | SP |
| 158 | 407612.1 | 199 | 261 | forward 1 | SP |
| 158 | 407612.1 | 403 | 474 | forward 1 | SP |
| 158 | 407612.1 | 458 | 547 | forward 2 | SP |
| 158 | 407612.1 | 229 | 282 | forward 1 | TM |
| 158 | 407612.1 | 199 | 288 | forward 1 | SP |
| 158 | 407612.1 | 2126 | 2215 | forward 2 | SP |
| 158 | 407612.1 | 3520 | 3597 | forward 1 | SP |
| 158 | 407612.1 | 3207 | 3269 | forward 3 | TM |
| 158 | 407612.1 | 3375 | 3437 | forward 3 | SP |
| 158 | 407612.1 | 214 | 276 | forward 1 | TM |

TABLE 4-continued

| SEQ ID NO | Template ID | Start | Stop | Frame | Hit Type |
|---|---|---|---|---|---|
| 158 | 407612.1 | 1381 | 1437 | forward 1 | TM |
| 158 | 407612.1 | 217 | 285 | forward 1 | TM |
| 158 | 407612.1 | 199 | 264 | forward 1 | SP |
| 159 | 399501.1 | 926 | 970 | forward 2 | SP |
| 159 | 399501.1 | 840 | 893 | forward 3 | TM |
| 159 | 399501.1 | 831 | 893 | forward 3 | TM |
| 162 | 199601.12 | 1493 | 1543 | forward 2 | TM |
| 162 | 199601.12 | 1481 | 1552 | forward 2 | TM |
| 162 | 199601.12 | 1481 | 1537 | forward 2 | TM |
| 163 | 232946.1 | 4459 | 4518 | forward 1 | SP |
| 163 | 232946.1 | 4459 | 4527 | forward 1 | SP |
| 163 | 232946.1 | 5418 | 5477 | forward 3 | TM |
| 163 | 232946.1 | 5072 | 5122 | forward 2 | TM |
| 163 | 232946.1 | 5130 | 5186 | forward 3 | TM |
| 163 | 232946.1 | 720 | 803 | forward 3 | SP |
| 163 | 232946.1 | 1361 | 1429 | forward 2 | SP |
| 163 | 232946.1 | 5190 | 5255 | forward 3 | SP |
| 163 | 232946.1 | 5193 | 5255 | forward 3 | TM |
| 163 | 232946.1 | 4467 | 4535 | forward 3 | TM |
| 163 | 232946.1 | 4459 | 4512 | forward 1 | SP |
| 163 | 232946.1 | 5208 | 5264 | forward 3 | TM |
| 163 | 232946.1 | 5069 | 5131 | forward 2 | TM |
| 163 | 232946.1 | 4440 | 4520 | forward 3 | SP |
| 163 | 232946.1 | 453 | 512 | forward 3 | SP |
| 163 | 232946.1 | 5190 | 5261 | forward 3 | SP |
| 163 | 232946.1 | 5078 | 5146 | forward 2 | TM |
| 163 | 232946.1 | 720 | 767 | forward 3 | SP |
| 163 | 232946.1 | 4476 | 4532 | forward 3 | TM |
| 163 | 232946.1 | 5157 | 5231 | forward 3 | TM |
| 163 | 232946.1 | 1361 | 1414 | forward 2 | SP |
| 163 | 232946.1 | 5214 | 5273 | forward 3 | TM |
| 163 | 232946.1 | 5199 | 5282 | forward 3 | TM |
| 163 | 232946.1 | 1361 | 1408 | forward 2 | SP |
| 168 | 1674368CD1 | 1 | 17 | | SP |
| 168 | 1674368CD1 | 1392 | 1410 | | TM |
| 168 | 1674368CD1 | 1388 | 1409 | | TM |
| 168 | 1674368CD1 | 1379 | 1407 | | SP |
| 168 | 1674368CD1 | 1385 | 1408 | | TM |
| 168 | 1674368CD1 | 1 | 18 | | SP |
| 170 | 464689.54 | 442 | 528 | forward 1 | SP |
| 171 | 222181.1 | 835 | 930 | forward 1 | SP |
| 171 | 222181.1 | 835 | 912 | forward 1 | SP |
| 171 | 222181.1 | 1044 | 1106 | forward 3 | TM |
| 171 | 222181.1 | 763 | 819 | forward 1 | SP |
| 171 | 222181.1 | 3075 | 3134 | forward 3 | SP |
| 171 | 222181.1 | 870 | 944 | forward 3 | TM |
| 171 | 222181.1 | 835 | 900 | forward 1 | SP |
| 171 | 222181.1 | 405 | 473 | forward 3 | TM |
| 171 | 222181.1 | 882 | 941 | forward 3 | TM |
| 171 | 222181.1 | 900 | 968 | forward 3 | TM |
| 171 | 222181.1 | 891 | 944 | forward 3 | TM |
| 171 | 222181.1 | 885 | 947 | forward 3 | TM |
| 174 | 1087445.1 | 1137 | 1214 | forward 3 | TM |
| 174 | 1087445.1 | 645 | 701 | forward 3 | TM |
| 175 | 1079625.3 | 2543 | 2596 | forward 2 | SP |
| 178 | 228046.5 | 172 | 258 | forward 1 | TM |
| 178 | 228046.5 | 1472 | 1564 | forward 2 | SP |
| 178 | 228046.5 | 872 | 934 | forward 2 | SP |
| 179 | 1225513.1 | 58 | 108 | forward 1 | SP |
| 179 | 1225513.1 | 58 | 123 | forward 1 | SP |
| 179 | 1225513.1 | 58 | 120 | forward 1 | SP |
| 179 | 1225513.1 | 58 | 111 | forward 1 | SP |
| 181 | 232849.13 | 1528 | 1575 | forward 1 | SP |
| 181 | 232849.13 | 337 | 402 | forward 1 | SP |
| 181 | 232849.13 | 1663 | 1713 | forward 1 | SP |
| 181 | 232849.13 | 1516 | 1584 | forward 1 | SP |
| 181 | 232849.13 | 1531 | 1590 | forward 1 | SP |
| 181 | 232849.13 | 1663 | 1719 | forward 1 | SP |
| 181 | 232849.13 | 1657 | 1719 | forward 1 | SP |
| 181 | 232849.13 | 1525 | 1581 | forward 1 | TM |
| 181 | 232849.13 | 1657 | 1722 | forward 1 | SP |
| 182 | 19598.1 | 59 | 127 | forward 2 | SP |
| 182 | 19598.1 | 59 | 133 | forward 2 | SP |
| 183 | 411148.3 | 3134 | 3193 | forward 2 | TM |
| 183 | 411148.3 | 3122 | 3181 | forward 2 | SP |
| 183 | 411148.3 | 315 | 389 | forward 3 | TM |
| 183 | 411148.3 | 327 | 386 | forward 3 | TM |
| 183 | 411148.3 | 5461 | 5505 | forward 1 | SP |
| 183 | 411148.3 | 3119 | 3193 | forward 2 | SP |
| 183 | 411148.3 | 2939 | 3013 | forward 2 | SP |
| 183 | 411148.3 | 3107 | 3193 | forward 2 | SP |
| 183 | 411148.3 | 5449 | 5511 | forward 1 | SP |
| 183 | 411148.3 | 1734 | 1817 | forward 3 | SP |
| 183 | 411148.3 | 5449 | 5514 | forward 1 | SP |
| 183 | 411148.3 | 5449 | 5505 | forward 1 | SP |
| 187 | 1273641CD1 | 107 | 123 | | TM |
| 187 | 1273641CD1 | 136 | 161 | | SP |
| 187 | 1273641CD1 | 105 | 124 | | TM |
| 187 | 1273641CD1 | 1 | 24 | | SP |
| 187 | 1273641CD1 | 136 | 161 | | SP |
| 187 | 1273641CD1 | 136 | 158 | | SP |
| 189 | 332165.8 | 168 | 251 | forward 3 | TM |
| 189 | 332165.8 | 1384 | 1449 | forward 1 | TM |
| 189 | 332165.8 | 1171 | 1242 | forward 1 | TM |
| 189 | 332165.8 | 1348 | 1434 | forward 1 | SP |
| 189 | 332165.8 | 1107 | 1160 | forward 3 | TM |
| 193 | 235356.1 | 372 | 428 | forward 3 | SP |
| 193 | 235356.1 | 1735 | 1812 | forward 1 | SP |
| 194 | 47593.1 | 252 | 314 | forward 3 | TM |
| 196 | 245687.1 | 411 | 494 | forward 3 | SP |
| 196 | 245687.1 | 423 | 494 | forward 3 | SP |
| 201 | 205542.2 | 2071 | 2115 | forward 1 | SP |
| 201 | 205542.2 | 2428 | 2496 | forward 1 | SP |
| 201 | 205542.2 | 2378 | 2434 | forward 2 | SP |
| 201 | 205542.2 | 4072 | 4131 | forward 1 | TM |
| 201 | 205542.2 | 3904 | 3972 | forward 1 | SP |
| 201 | 205542.2 | 4407 | 4469 | forward 3 | TM |
| 201 | 205542.2 | 2378 | 2449 | forward 2 | SP |
| 201 | 205542.2 | 262 | 345 | forward 1 | SP |
| 201 | 205542.2 | 2174 | 2254 | forward 2 | SP |
| 201 | 205542.2 | 4051 | 4104 | forward 1 | TM |
| 201 | 205542.2 | 2041 | 2103 | forward 1 | TM |
| 201 | 205542.2 | 2437 | 2496 | forward 1 | SP |
| 201 | 205542.2 | 4008 | 4061 | forward 3 | TM |
| 201 | 205542.2 | 2293 | 2367 | forward 1 | SP |
| 201 | 205542.2 | 2284 | 2349 | forward 1 | SP |
| 201 | 205542.2 | 2428 | 2487 | forward 1 | TM |
| 201 | 205542.2 | 4410 | 4478 | forward 3 | TM |
| 201 | 205542.2 | 2378 | 2443 | forward 2 | SP |
| 201 | 205542.2 | 2428 | 2496 | forward 1 | TM |
| 201 | 205542.2 | 2293 | 2349 | forward 1 | SP |
| 201 | 205542.2 | 2378 | 2476 | forward 2 | SP |
| 201 | 205542.2 | 2302 | 2349 | forward 1 | SP |
| 201 | 205542.2 | 4069 | 4131 | forward 1 | TM |
| 201 | 205542.2 | 2437 | 2490 | forward 1 | SP |
| 201 | 205542.2 | 262 | 327 | forward 1 | SP |
| 201 | 205542.2 | 262 | 324 | forward 1 | SP |
| 201 | 205542.2 | 262 | 333 | forward 1 | SP |
| 206 | 219537.1 | 376 | 426 | forward 1 | TM |
| 207 | 1041138.7 | 504 | 566 | forward 3 | TM |
| 207 | 1041138.7 | 688 | 741 | forward 1 | TM |
| 207 | 1041138.7 | 2591 | 2650 | forward 2 | SP |
| 207 | 1041138.7 | 2805 | 2888 | forward 3 | SP |
| 207 | 1041138.7 | 498 | 569 | forward 3 | TM |
| 210 | 232386.18 | 2705 | 2761 | forward 2 | TM |
| 210 | 232386.18 | 2583 | 2636 | forward 3 | TM |
| 210 | 232386.18 | 2693 | 2764 | forward 2 | TM |
| 216 | 1405844CD1 | 208 | 225 | | TM |
| 216 | 1405844CD1 | 57 | 79 | | TM |
| 216 | 1405844CD1 | 86 | 106 | | TM |
| 216 | 1405844CD1 | 17 | 35 | | TM |
| 216 | 1405844CD1 | 52 | 69 | | TM |
| 216 | 1405844CD1 | 62 | 88 | | TM |
| 216 | 1405844CD1 | 12 | 28 | | SP |
| 216 | 1405844CD1 | 12 | 35 | | SP |
| 216 | 1405844CD1 | 12 | 36 | | SP |
| 216 | 1405844CD1 | 54 | 74 | | TM |
| 216 | 1405844CD1 | 17 | 37 | | TM |
| 216 | 1405844CD1 | 84 | 100 | | SP |
| 216 | 1405844CD1 | 51 | 72 | | TM |
| 216 | 1405844CD1 | 12 | 41 | | SP |
| 216 | 1405844CD1 | 84 | 106 | | SP |
| 216 | 1405844CD1 | 206 | 225 | | TM |
| 216 | 1405844CD1 | 10 | 37 | | TM |

TABLE 4-continued

| SEQ ID NO | Template ID | Start | Stop | Frame | Hit Type |
|---|---|---|---|---|---|
| 216 | 1405844CD1 | 58 | 77 | | TM |
| 216 | 1405844CD1 | 90 | 109 | | TM |
| 216 | 1405844CD1 | 12 | 30 | | SP |
| 216 | 1405844CD1 | 206 | 227 | | TM |
| 216 | 1405844CD1 | 10 | 35 | | TM |
| 216 | 1405844CD1 | 84 | 101 | | TM |
| 216 | 1405844CD1 | 84 | 102 | | SP |
| 216 | 1405844CD1 | 67 | 103 | | SP |
| 216 | 1405844CD1 | 87 | 109 | | TM |
| 216 | 1405844CD1 | 205 | 226 | | TM |
| 216 | 1405844CD1 | 205 | 229 | | TM |
| 216 | 1405844CD1 | 84 | 106 | | SP |
| 216 | 1405844CD1 | 84 | 103 | | SP |
| 216 | 1405844CD1 | 10 | 32 | | TM |
| 216 | 1405844CD1 | 85 | 108 | | TM |
| 217 | 1143377.5 | 106 | 162 | forward 1 | SP |
| 217 | 1143377.5 | 309 | 371 | forward 3 | SP |
| 218 | 235147.1 | 950 | 1039 | forward 2 | SP |
| 218 | 235147.1 | 1040 | 1129 | forward 2 | SP |
| 218 | 235147.1 | 1113 | 1157 | forward 3 | SP |
| 218 | 235147.1 | 194 | 268 | forward 2 | SP |
| 218 | 235147.1 | 4307 | 4366 | forward 2 | TM |
| 218 | 235147.1 | 3935 | 3991 | forward 2 | SP |
| 218 | 235147.1 | 2687 | 2749 | forward 2 | TM |
| 218 | 235147.1 | 2152 | 2220 | forward 1 | TM |
| 218 | 235147.1 | 3940 | 3990 | forward 1 | TM |
| 218 | 235147.1 | 1174 | 1233 | forward 1 | SP |
| 218 | 235147.1 | 2614 | 2664 | forward 1 | TM |
| 218 | 235147.1 | 2164 | 2223 | forward 1 | TM |
| 218 | 235147.1 | 106 | 168 | forward 1 | SP |
| 218 | 235147.1 | 1414 | 1458 | forward 1 | SP |
| 218 | 235147.1 | 2164 | 2226 | forward 1 | TM |
| 218 | 235147.1 | 3982 | 4041 | forward 1 | SP |
| 218 | 235147.1 | 3943 | 4005 | forward 1 | TM |
| 218 | 235147.1 | 2696 | 2767 | forward 2 | TM |
| 218 | 235147.1 | 3513 | 3566 | forward 3 | TM |
| 218 | 235147.1 | 719 | 778 | forward 2 | TM |
| 218 | 235147.1 | 3937 | 4008 | forward 1 | TM |
| 218 | 235147.1 | 3947 | 4030 | forward 2 | TM |
| 218 | 235147.1 | 3510 | 3569 | forward 3 | TM |
| 218 | 235147.1 | 3927 | 3986 | forward 3 | TM |
| 218 | 235147.1 | 3967 | 4026 | forward 1 | TM |
| 218 | 235147.1 | 3944 | 4003 | forward 2 | TM |
| 219 | 235147.2 | 951 | 1040 | forward 3 | SP |
| 219 | 235147.2 | 195 | 269 | forward 3 | SP |
| 219 | 235147.2 | 1435 | 1494 | forward 1 | TM |
| 219 | 235147.2 | 720 | 779 | forward 3 | TM |
| 219 | 235147.2 | 107 | 169 | forward 2 | SP |
| 219 | 235147.2 | 1490 | 1549 | forward 2 | SP |
| 219 | 235147.2 | 1475 | 1534 | forward 2 | TM |
| 219 | 235147.2 | 1452 | 1511 | forward 3 | TM |
| 220 | 1099294.6 | 898 | 951 | forward 1 | SP |
| 220 | 1099294.6 | 842 | 943 | forward 2 | SP |
| 221 | 330927.1 | 57 | 128 | forward 3 | TM |
| 221 | 330927.1 | 205 | 258 | forward 1 | SP |
| 221 | 330927.1 | 205 | 255 | forward 1 | SP |
| 222 | 50695.1 | 348 | 410 | forward 3 | TM |
| 222 | 50695.1 | 145 | 198 | forward 1 | TM |
| 222 | 50695.1 | 109 | 195 | forward 1 | TM |
| 224 | 282397.77 | 5909 | 5977 | forward 2 | TM |
| 224 | 282397.77 | 3675 | 3779 | forward 3 | SP |
| 224 | 282397.77 | 6071 | 6130 | forward 2 | TM |
| 224 | 282397.77 | 5904 | 5957 | forward 3 | TM |
| 224 | 282397.77 | 4241 | 4297 | forward 2 | SP |
| 224 | 282397.77 | 6071 | 6130 | forward 2 | SP |
| 224 | 282397.77 | 2671 | 2733 | forward 1 | SP |
| 224 | 282397.77 | 4214 | 4297 | forward 2 | SP |
| 225 | 984009.2 | 376 | 429 | forward 1 | TM |
| 225 | 984009.2 | 113 | 169 | forward 2 | SP |
| 225 | 984009.2 | 113 | 169 | forward 2 | SP |
| 226 | 138709.5 | 1902 | 1964 | forward 3 | TM |
| 226 | 138709.5 | 1926 | 2006 | forward 3 | TM |
| 226 | 138709.5 | 2257 | 2319 | forward 1 | TM |
| 226 | 138709.5 | 1468 | 1533 | forward 1 | TM |
| 226 | 138709.5 | 2292 | 2348 | forward 3 | TM |
| 226 | 138709.5 | 1848 | 1916 | forward 3 | SP |
| 226 | 138709.5 | 1435 | 1485 | forward 1 | TM |
| 226 | 138709.5 | 2295 | 2345 | forward 3 | TM |
| 226 | 138709.5 | 1435 | 1509 | forward 1 | TM |
| 226 | 138709.5 | 1438 | 1494 | forward 1 | TM |
| 227 | 998926.1 | 2659 | 2727 | forward 1 | SP |
| 227 | 998926.1 | 2656 | 2745 | forward 1 | SP |
| 227 | 998926.1 | 2680 | 2739 | forward 1 | TM |
| 227 | 998926.1 | 2659 | 2736 | forward 1 | SP |
| 227 | 998926.1 | 2621 | 2692 | forward 2 | TM |
| 229 | 1448817CD1 | 9 | 26 | | TM |
| 229 | 1448817CD1 | 7 | 24 | | SP |
| 229 | 1448817CD1 | 1 | 31 | | SP |
| 229 | 1448817CD1 | 1 | 24 | | SP |
| 229 | 1448817CD1 | 1 | 25 | | SP |
| 230 | 332521.1 | 130 | 201 | forward 1 | TM |
| 230 | 332521.1 | 934 | 1011 | forward 1 | SP |
| 230 | 332521.1 | 943 | 1011 | forward 1 | SP |
| 230 | 332521.1 | 172 | 231 | forward 1 | TM |
| 231 | 245136.4 | 1783 | 1857 | forward 1 | SP |
| 231 | 245136.4 | 1792 | 1857 | forward 1 | SP |
| 231 | 245136.4 | 1809 | 1862 | forward 3 | TM |
| 231 | 245136.4 | 1804 | 1863 | forward 1 | SP |
| 231 | 245136.4 | 1765 | 1827 | forward 1 | TM |
| 231 | 245136.4 | 1804 | 1857 | forward 1 | SP |
| 231 | 245136.4 | 1804 | 1851 | forward 1 | SP |
| 231 | 245136.4 | 1795 | 1851 | forward 1 | TM |
| 240 | 997142.1 | 35 | 91 | forward 2 | TM |
| 241 | 997080.1 | 1473 | 1550 | forward 3 | TM |
| 241 | 997080.1 | 2741 | 2791 | forward 2 | TM |
| 241 | 997080.1 | 2726 | 2791 | forward 2 | SP |
| 241 | 997080.1 | 1668 | 1724 | forward 3 | TM |
| 241 | 997080.1 | 1503 | 1565 | forward 3 | TM |
| 241 | 997080.1 | 501 | 554 | forward 3 | SP |
| 241 | 997080.1 | 2747 | 2809 | forward 2 | TM |
| 241 | 997080.1 | 300 | 362 | forward 3 | TM |
| 241 | 997080.1 | 2704 | 2766 | forward 1 | SP |
| 241 | 997080.1 | 1677 | 1730 | forward 3 | TM |
| 241 | 997080.1 | 30 | 92 | forward 3 | SP |
| 241 | 997080.1 | 30 | 104 | forward 3 | SP |
| 241 | 997080.1 | 30 | 86 | forward 3 | SP |
| 241 | 997080.1 | 2729 | 2785 | forward 2 | TM |
| 241 | 997080.1 | 30 | 98 | forward 3 | SP |
| 243 | 379571.7 | 7078 | 7146 | forward 1 | TM |
| 243 | 379571.7 | 4435 | 4491 | forward 1 | SP |
| 243 | 379571.7 | 6162 | 6218 | forward 3 | SP |
| 243 | 379571.7 | 6668 | 6724 | forward 2 | SP |
| 243 | 379571.7 | 4435 | 4494 | forward 1 | SP |
| 243 | 379571.7 | 1747 | 1830 | forward 1 | SP |
| 243 | 379571.7 | 6665 | 6733 | forward 2 | SP |
| 243 | 379571.7 | 6304 | 6360 | forward 1 | SP |
| 243 | 379571.7 | 5842 | 5901 | forward 1 | SP |
| 243 | 379571.7 | 4435 | 4500 | forward 1 | SP |
| 243 | 379571.7 | 6665 | 6727 | forward 2 | SP |
| 243 | 379571.7 | 6665 | 6736 | forward 2 | SP |
| 244 | 322303.15 | 250 | 312 | forward 1 | SP |
| 244 | 322303.15 | 1364 | 1432 | forward 2 | SP |
| 244 | 322303.15 | 2655 | 2720 | forward 3 | SP |
| 244 | 322303.15 | 7555 | 7605 | forward 1 | TM |
| 244 | 322303.15 | 2655 | 2711 | forward 3 | SP |
| 244 | 322303.15 | 271 | 324 | forward 1 | SP |
| 244 | 322303.15 | 250 | 315 | forward 1 | SP |
| 244 | 322303.15 | 250 | 330 | forward 1 | SP |
| 244 | 322303.15 | 7564 | 7650 | forward 1 | TM |
| 244 | 322303.15 | 250 | 324 | forward 1 | SP |
| 245 | 232935.2 | 2351 | 2431 | forward 2 | TM |
| 245 | 232935.2 | 5338 | 5400 | forward 1 | TM |
| 245 | 232935.2 | 3408 | 3464 | forward 3 | TM |
| 245 | 232935.2 | 3706 | 3768 | forward 1 | TM |
| 245 | 232935.2 | 3711 | 3770 | forward 3 | TM |
| 245 | 232935.2 | 423 | 503 | forward 3 | SP |
| 245 | 232935.2 | 5597 | 5665 | forward 2 | SP |
| 245 | 232935.2 | 2351 | 2404 | forward 2 | TM |
| 245 | 232935.2 | 2336 | 2407 | forward 2 | TM |
| 245 | 232935.2 | 3706 | 3759 | forward 1 | SP |
| 245 | 232935.2 | 2351 | 2413 | forward 2 | TM |
| 245 | 232935.2 | 2333 | 2389 | forward 2 | TM |
| 245 | 232935.2 | 2318 | 2386 | forward 2 | TM |
| 248 | 69812.3 | 3587 | 3661 | forward 2 | SP |

TABLE 4-continued

| SEQ ID NO | Template ID | Start | Stop | Frame | Hit Type |
|---|---|---|---|---|---|
| 248 | 69812.3 | 3576 | 3626 | forward 3 | SP |
| 248 | 69812.3 | 3576 | 3638 | forward 3 | SP |
| 252 | 1518310CD1 | 23 | 39 | | TM |
| 253 | 241335.1 | 658 | 753 | forward 1 | SP |
| 253 | 241335.1 | 1674 | 1754 | forward 3 | TM |
| 253 | 241335.1 | 684 | 752 | forward 3 | TM |
| 253 | 241335.1 | 702 | 773 | forward 3 | TM |
| 253 | 241335.1 | 711 | 773 | forward 3 | TM |
| 253 | 241335.1 | 711 | 764 | forward 3 | TM |
| 253 | 241335.1 | 702 | 758 | forward 3 | TM |
| 255 | 25911.1 | 1226 | 1291 | forward 2 | SP |
| 257 | 978673.2 | 1043 | 1099 | forward 2 | TM |
| 257 | 978673.2 | 1019 | 1084 | forward 2 | SP |
| 257 | 978673.2 | 956 | 1015 | forward 2 | TM |
| 257 | 978673.2 | 965 | 1027 | forward 2 | TM |
| 257 | 978673.2 | 161 | 250 | forward 2 | SP |
| 257 | 978673.2 | 950 | 1018 | forward 2 | TM |
| 257 | 978673.2 | 1007 | 1084 | forward 2 | SP |
| 261 | 20602.1 | 138 | 191 | forward 3 | TM |
| 263 | 399872.1 | 632 | 694 | forward 2 | TM |
| 265 | 229176.5 | 898 | 951 | forward 1 | TM |
| 265 | 229176.5 | 1377 | 1421 | forward 3 | SP |
| 265 | 229176.5 | 1277 | 1321 | forward 2 | SP |
| 268 | 994387.65 | 4021 | 4080 | forward 1 | TM |
| 268 | 994387.65 | 6137 | 6193 | forward 2 | SP |
| 268 | 994387.65 | 2583 | 2654 | forward 3 | TM |
| 268 | 994387.65 | 5220 | 5270 | forward 3 | TM |
| 268 | 994387.65 | 2634 | 2684 | forward 3 | TM |
| 268 | 994387.65 | 6137 | 6184 | forward 2 | SP |
| 268 | 994387.65 | 4229 | 4276 | forward 2 | TM |
| 268 | 994387.65 | 4069 | 4140 | forward 1 | SP |
| 268 | 994387.65 | 2592 | 2654 | forward 3 | TM |
| 268 | 994387.65 | 2589 | 2645 | forward 3 | TM |
| 268 | 994387.65 | 2568 | 2621 | forward 3 | TM |
| 268 | 994387.65 | 5193 | 5279 | forward 3 | TM |
| 268 | 994387.65 | 6131 | 6214 | forward 2 | TM |
| 268 | 994387.65 | 6125 | 6178 | forward 2 | TM |
| 268 | 994387.65 | 4018 | 4068 | forward 1 | TM |
| 268 | 994387.65 | 6137 | 6196 | forward 2 | SP |
| 268 | 994387.65 | 4069 | 4149 | forward 1 | SP |
| 268 | 994387.65 | 2583 | 2651 | forward 3 | TM |
| 268 | 994387.65 | 6143 | 6214 | forward 2 | TM |
| 268 | 994387.65 | 6125 | 6181 | forward 2 | TM |
| 269 | 201462.7 | 383 | 436 | forward 2 | TM |
| 270 | 991497.1 | 667 | 741 | forward 1 | SP |
| 270 | 991497.1 | 146 | 226 | forward 2 | SP |
| 270 | 991497.1 | 146 | 211 | forward 2 | SP |
| 271 | 347444.1 | 1011 | 1067 | forward 3 | TM |
| 271 | 347444.1 | 1008 | 1061 | forward 3 | TM |
| 271 | 347444.1 | 1005 | 1070 | forward 3 | SP |
| 271 | 347444.1 | 997 | 1056 | forward 1 | TM |
| 271 | 347444.1 | 992 | 1066 | forward 2 | SP |
| 271 | 347444.1 | 1299 | 1367 | forward 3 | SP |
| 271 | 347444.1 | 1010 | 1069 | forward 2 | TM |
| 271 | 347444.1 | 1000 | 1089 | forward 1 | TM |
| 271 | 347444.1 | 1194 | 1250 | forward 3 | TM |
| 272 | 238660.5 | 5330 | 5401 | forward 2 | SP |
| 272 | 238660.5 | 4546 | 4629 | forward 1 | SP |
| 273 | 404601.11 | 1473 | 1535 | forward 3 | TM |
| 273 | 404601.11 | 1346 | 1417 | forward 2 | TM |
| 274 | 1329936.3 | 929 | 1006 | forward 2 | TM |
| 274 | 1329936.3 | 1065 | 1118 | forward 3 | TM |
| 274 | 1329936.3 | 1058 | 1123 | forward 2 | SP |
| 274 | 1329936.3 | 444 | 503 | forward 3 | TM |
| 274 | 1329936.3 | 564 | 632 | forward 3 | SP |
| 274 | 1329936.3 | 932 | 1000 | forward 2 | TM |
| 274 | 1329936.3 | 938 | 997 | forward 2 | TM |
| 274 | 1329936.3 | 564 | 623 | forward 3 | TM |
| 274 | 1329936.3 | 564 | 608 | forward 3 | SP |
| 274 | 1329936.3 | 564 | 617 | forward 3 | SP |
| 274 | 1329936.3 | 789 | 845 | forward 3 | TM |
| 274 | 1329936.3 | 561 | 641 | forward 3 | TM |
| 274 | 1329936.3 | 432 | 500 | forward 3 | TM |
| 274 | 1329936.3 | 780 | 863 | forward 3 | TM |
| 275 | 370489.47 | 865 | 933 | forward 1 | SP |
| 275 | 370489.47 | 857 | 910 | forward 2 | TM |
| 275 | 370489.47 | 891 | 968 | forward 3 | TM |
| 275 | 370489.47 | 840 | 893 | forward 3 | TM |
| 275 | 370489.47 | 805 | 864 | forward 1 | SP |
| 278 | 1822864CD1 | 8 | 28 | | SP |
| 278 | 1822864CD1 | 6 | 27 | | SP |
| 278 | 1822864CD1 | 1 | 25 | | SP |
| 278 | 1822864CD1 | 1 | 27 | | SP |
| 283 | 407263.1 | 2916 | 2987 | forward 3 | TM |
| 283 | 407263.1 | 2895 | 2969 | forward 3 | TM |
| 283 | 407263.1 | 2896 | 2949 | forward 1 | TM |
| 283 | 407263.1 | 2925 | 2984 | forward 3 | TM |
| 283 | 407263.1 | 2896 | 2955 | forward 1 | TM |
| 285 | 1630551CD1 | 60 | 84 | | SP |
| 285 | 1630551CD1 | 288 | 304 | | TM |
| 289 | 92230.2 | 487 | 564 | forward 1 | SP |
| 291 | 333542.1 | 1124 | 1195 | forward 2 | TM |
| 291 | 333542.1 | 1143 | 1214 | forward 3 | SP |
| 294 | 476760.12 | 490 | 561 | forward 1 | SP |
| 298 | 197652.3 | 1450 | 1503 | forward 1 | SP |
| 298 | 197652.3 | 735 | 791 | forward 3 | TM |
| 299 | 248203.2 | 740 | 793 | forward 2 | TM |
| 299 | 248203.2 | 888 | 956 | forward 3 | SP |
| 299 | 248203.2 | 713 | 781 | forward 2 | TM |
| 299 | 248203.2 | 728 | 790 | forward 2 | TM |
| 299 | 248203.2 | 734 | 799 | forward 2 | TM |
| 301 | 2023351CD1 | 1 | 20 | | SP |
| 301 | 2023351CD1 | 1 | 19 | | SP |
| 303 | 92268.1 | 263 | 352 | forward 2 | SP |
| 303 | 92268.1 | 262 | 351 | forward 1 | SP |
| 303 | 92268.1 | 2411 | 2485 | forward 2 | SP |
| 303 | 92268.1 | 1652 | 1732 | forward 2 | SP |
| 303 | 92268.1 | 2393 | 2485 | forward 2 | SP |
| 306 | 898877.6 | 325 | 387 | forward 1 | TM |
| 306 | 898877.6 | 245 | 298 | forward 2 | SP |
| 307 | 29490.1 | 363 | 416 | forward 3 | TM |
| 310 | 369213.42 | 50 | 115 | forward 2 | SP |
| 310 | 369213.42 | 181 | 282 | forward 1 | SP |
| 310 | 369213.42 | 289 | 348 | forward 1 | TM |
| 310 | 369213.42 | 35 | 91 | forward 2 | TM |
| 310 | 369213.42 | 289 | 351 | forward 1 | TM |
| 310 | 369213.42 | 1185 | 1238 | forward 3 | SP |
| 310 | 369213.42 | 74 | 157 | forward 2 | SP |
| 310 | 369213.42 | 277 | 342 | forward 1 | TM |
| 310 | 369213.42 | 277 | 351 | forward 1 | TM |
| 315 | 223407.4 | 1873 | 1956 | forward 1 | SP |
| 315 | 223407.4 | 1866 | 1919 | forward 3 | TM |
| 316 | 899334.1 | 3907 | 3963 | forward 1 | TM |
| 316 | 899334.1 | 2540 | 2593 | forward 2 | TM |
| 316 | 899334.1 | 3901 | 3966 | forward 1 | SP |
| 316 | 899334.1 | 2555 | 2605 | forward 2 | SP |
| 316 | 899334.1 | 1418 | 1486 | forward 2 | SP |
| 316 | 899334.1 | 2525 | 2590 | forward 2 | SP |
| 316 | 899334.1 | 1009 | 1083 | forward 1 | SP |
| 316 | 899334.1 | 2090 | 2149 | forward 2 | SP |
| 316 | 899334.1 | 1418 | 1492 | forward 2 | SP |
| 316 | 899334.1 | 2090 | 2161 | forward 2 | SP |
| 316 | 899334.1 | 3922 | 3993 | forward 1 | TM |
| 316 | 899334.1 | 3940 | 4002 | forward 1 | TM |
| 316 | 899334.1 | 2555 | 2611 | forward 2 | SP |
| 316 | 899334.1 | 1009 | 1092 | forward 1 | SP |
| 316 | 899334.1 | 3901 | 3981 | forward 1 | TM |
| 318 | 1149046.1 | 1534 | 1596 | forward 1 | TM |
| 318 | 1149046.1 | 1558 | 1626 | forward 1 | TM |
| 318 | 1149046.1 | 1598 | 1669 | forward 2 | TM |
| 318 | 1149046.1 | 1531 | 1581 | forward 1 | TM |
| 318 | 1149046.1 | 1598 | 1663 | forward 2 | SP |
| 318 | 1149046.1 | 2495 | 2572 | forward 2 | TM |
| 318 | 1149046.1 | 1534 | 1593 | forward 1 | TM |
| 318 | 1149046.1 | 1583 | 1639 | forward 2 | TM |
| 319 | 404011.3 | 210 | 296 | forward 3 | SP |
| 321 | 3768043CD1 | 37 | 58 | | TM |
| 321 | 3768043CD1 | 45 | 63 | | TM |
| 322 | 39946.19 | 2706 | 2768 | forward 3 | TM |
| 322 | 39946.19 | 1959 | 2033 | forward 3 | SP |
| 322 | 39946.19 | 1974 | 2021 | forward 3 | SP |
| 322 | 39946.19 | 140 | 214 | forward 2 | SP |
| 322 | 39946.19 | 1944 | 2033 | forward 3 | SP |
| 322 | 39946.19 | 1974 | 2027 | forward 3 | SP |

TABLE 4-continued

| SEQ ID NO | Template ID | Start | Stop | Frame | Hit Type |
|---|---|---|---|---|---|
| 322 | 39946.19 | 1974 | 2033 | forward 3 | SP |
| 327 | 232772.13 | 820 | 900 | forward 1 | TM |
| 327 | 232772.13 | 361 | 423 | forward 1 | SP |
| 327 | 232772.13 | 64 | 123 | forward 1 | SP |
| 327 | 232772.13 | 64 | 120 | forward 1 | TM |
| 327 | 232772.13 | 77 | 133 | forward 2 | TM |
| 327 | 232772.13 | 84 | 143 | forward 3 | TM |
| 328 | 407451.3 | 905 | 967 | forward 2 | TM |
| 328 | 407451.3 | 140 | 187 | forward 2 | SP |
| 328 | 407451.3 | 899 | 955 | forward 2 | TM |
| 329 | 1382931.2 | 1143 | 1226 | forward 3 | SP |
| 330 | 1382931.39 | 780 | 854 | forward 3 | SP |
| 330 | 1382931.39 | 747 | 830 | forward 3 | SP |
| 333 | 402366.1 | 843 | 917 | forward 3 | SP |
| 334 | 401532.3 | 151 | 213 | forward 1 | SP |
| 334 | 401532.3 | 151 | 219 | forward 1 | SP |
| 334 | 401532.3 | 151 | 243 | forward 1 | SP |
| 335 | 401532.2 | 5624 | 5683 | forward 2 | TM |
| 335 | 401532.2 | 305 | 367 | forward 2 | TM |
| 335 | 401532.2 | 4317 | 4379 | forward 3 | SP |
| 335 | 401532.2 | 5236 | 5295 | forward 1 | TM |
| 335 | 401532.2 | 5626 | 5688 | forward 1 | TM |
| 335 | 401532.2 | 5642 | 5695 | forward 2 | TM |
| 335 | 401532.2 | 5245 | 5316 | forward 1 | TM |
| 335 | 401532.2 | 5501 | 5566 | forward 2 | TM |
| 335 | 401532.2 | 1478 | 1540 | forward 2 | TM |
| 335 | 401532.2 | 1178 | 1234 | forward 2 | TM |
| 335 | 401532.2 | 5239 | 5292 | forward 1 | TM |
| 335 | 401532.2 | 3740 | 3796 | forward 2 | TM |
| 335 | 401532.2 | 5586 | 5642 | forward 3 | SP |
| 335 | 401532.2 | 5586 | 5636 | forward 3 | SP |
| 335 | 401532.2 | 497 | 550 | forward 2 | TM |
| 335 | 401532.2 | 5592 | 5669 | forward 3 | TM |
| 335 | 401532.2 | 185 | 238 | forward 2 | TM |
| 335 | 401532.2 | 5586 | 5657 | forward 3 | SP |
| 335 | 401532.2 | 5586 | 5657 | forward 3 | SP |
| 335 | 401532.2 | 5248 | 5328 | forward 1 | TM |
| 335 | 401532.2 | 5586 | 5645 | forward 3 | SP |
| 335 | 401532.2 | 1427 | 1489 | forward 2 | SP |
| 335 | 401532.2 | 5599 | 5652 | forward 1 | TM |
| 335 | 401532.2 | 1421 | 1492 | forward 2 | SP |
| 335 | 401532.2 | 1421 | 1504 | forward 2 | SP |
| 335 | 401532.2 | 3455 | 3538 | forward 2 | TM |
| 335 | 401532.2 | 3440 | 3490 | forward 2 | TM |
| 335 | 401532.2 | 4317 | 4385 | forward 3 | SP |
| 335 | 401532.2 | 5617 | 5673 | forward 1 | TM |
| 335 | 401532.2 | 3014 | 3076 | forward 2 | TM |
| 335 | 401532.2 | 5595 | 5645 | forward 3 | TM |
| 335 | 401532.2 | 3017 | 3073 | forward 2 | TM |
| 335 | 401532.2 | 1421 | 1489 | forward 2 | SP |
| 335 | 401532.2 | 5586 | 5645 | forward 3 | TM |
| 335 | 401532.2 | 4989 | 5057 | forward 3 | TM |
| 335 | 401532.2 | 4317 | 4400 | forward 3 | SP |
| 335 | 401532.2 | 3455 | 3511 | forward 2 | TM |
| 335 | 401532.2 | 5550 | 5624 | forward 3 | TM |
| 335 | 401532.2 | 2999 | 3073 | forward 2 | TM |
| 336 | 407896.4 | 1564 | 1629 | forward 1 | SP |
| 337 | 982625.1 | 361 | 426 | forward 1 | SP |
| 338 | 59947.1 | 979 | 1026 | forward 1 | TM |
| 338 | 59947.1 | 971 | 1021 | forward 2 | TM |
| 338 | 59947.1 | 967 | 1026 | forward 1 | TM |
| 338 | 59947.1 | 975 | 1028 | forward 3 | TM |
| 338 | 59947.1 | 966 | 1031 | forward 3 | TM |
| 338 | 59947.1 | 972 | 1028 | forward 3 | TM |
| 339 | 902471.11 | 1140 | 1232 | forward 3 | TM |
| 339 | 902471.11 | 1117 | 1170 | forward 1 | TM |
| 341 | 193755.1 | 788 | 856 | forward 2 | SP |
| 341 | 193755.1 | 788 | 859 | forward 2 | SP |
| 341 | 193755.1 | 590 | 640 | forward 2 | TM |
| 341 | 193755.1 | 3327 | 3380 | forward 3 | TM |
| 341 | 193755.1 | 2643 | 2711 | forward 3 | TM |
| 341 | 193755.1 | 2658 | 2720 | forward 3 | TM |
| 341 | 193755.1 | 2652 | 2705 | forward 3 | TM |
| 341 | 193755.1 | 1497 | 1571 | forward 3 | SP |
| 341 | 193755.1 | 3087 | 3146 | forward 3 | TM |
| 341 | 193755.1 | 3308 | 3394 | forward 2 | TM |
| 341 | 193755.1 | 1926 | 2009 | forward 3 | SP |
| 341 | 193755.1 | 3301 | 3363 | forward 1 | TM |
| 341 | 193755.1 | 3535 | 3591 | forward 1 | SP |
| 341 | 193755.1 | 3313 | 3363 | forward 1 | TM |
| 341 | 193755.1 | 3307 | 3387 | forward 1 | TM |
| 341 | 193755.1 | 3310 | 3378 | forward 1 | TM |
| 341 | 193755.1 | 2634 | 2711 | forward 3 | TM |
| 341 | 193755.1 | 3310 | 3369 | forward 1 | TM |
| 341 | 193755.1 | 2658 | 2717 | forward 3 | TM |
| 345 | 1129157.1 | 88 | 135 | forward 1 | SP |
| 345 | 1129157.1 | 61 | 132 | forward 1 | SP |
| 345 | 1129157.1 | 61 | 123 | forward 1 | SP |
| 345 | 1129157.1 | 61 | 135 | forward 1 | SP |
| 345 | 1129157.1 | 61 | 141 | forward 1 | SP |
| 347 | 1804734CD1 | 231 | 251 | | TM |
| 347 | 1804734CD1 | 41 | 60 | | TM |
| 348 | 43646.7 | 2035 | 2094 | forward 1 | TM |
| 348 | 43646.7 | 1615 | 1674 | forward 1 | TM |
| 349 | 43646.1 | 1322 | 1381 | forward 2 | TM |
| 349 | 43646.1 | 899 | 982 | forward 2 | TM |
| 353 | 415378.3 | 2504 | 2569 | forward 2 | TM |
| 353 | 415378.3 | 2884 | 2949 | forward 1 | SP |
| 353 | 415378.3 | 2501 | 2584 | forward 2 | SP |
| 353 | 415378.3 | 4000 | 4050 | forward 1 | TM |
| 353 | 415378.3 | 26 | 109 | forward 2 | SP |
| 354 | 25685.3 | 177 | 245 | forward 3 | SP |
| 354 | 25685.3 | 177 | 233 | forward 3 | SP |
| 354 | 25685.3 | 177 | 239 | forward 3 | SP |
| 355 | 400427.1 | 1815 | 1871 | forward 3 | TM |
| 355 | 400427.1 | 1830 | 1874 | forward 3 | TM |
| 356 | 198008.8 | 2348 | 2419 | forward 2 | SP |
| 356 | 198008.8 | 4479 | 4538 | forward 2 | SP |
| 356 | 198008.8 | 857 | 907 | forward 2 | TM |
| 356 | 198008.8 | 1164 | 1232 | forward 3 | SP |
| 356 | 198008.8 | 3308 | 3379 | forward 2 | SP |
| 356 | 198008.8 | 2348 | 2401 | forward 2 | SP |
| 356 | 198008.8 | 626 | 703 | forward 2 | SP |
| 356 | 198008.8 | 5292 | 5348 | forward 3 | SP |
| 356 | 198008.8 | 317 | 403 | forward 2 | SP |
| 358 | 1825508CD1 | 5 | 21 | | SP |
| 358 | 1825508CD1 | 2 | 20 | | SP |
| 358 | 1825508CD1 | 1 | 27 | | SP |
| 358 | 1825508CD1 | 1 | 23 | | SP |
| 358 | 1825508CD1 | 5 | 24 | | SP |
| 358 | 1825508CD1 | 1 | 25 | | SP |
| 360 | 980807.1 | 230 | 292 | forward 2 | SP |
| 360 | 980807.1 | 254 | 331 | forward 2 | SP |
| 361 | 1095192.1 | 175 | 228 | forward 1 | TM |
| 361 | 1095192.1 | 346 | 399 | forward 1 | TM |
| 361 | 1095192.1 | 1784 | 1846 | forward 2 | TM |
| 361 | 1095192.1 | 1867 | 1929 | forward 1 | TM |
| 361 | 1095192.1 | 730 | 783 | forward 1 | TM |
| 361 | 1095192.1 | 2355 | 2405 | forward 3 | TM |
| 361 | 1095192.1 | 457 | 510 | forward 1 | TM |
| 361 | 1095192.1 | 259 | 315 | forward 1 | TM |
| 361 | 1095192.1 | 76 | 135 | forward 1 | TM |
| 361 | 1095192.1 | 421 | 492 | forward 1 | TM |
| 361 | 1095192.1 | 451 | 528 | forward 1 | TM |
| 361 | 1095192.1 | 439 | 519 | forward 1 | SP |
| 361 | 1095192.1 | 224 | 277 | forward 2 | TM |
| 361 | 1095192.1 | 442 | 504 | forward 1 | SP |
| 361 | 1095192.1 | 224 | 292 | forward 2 | TM |
| 361 | 1095192.1 | 466 | 534 | forward 1 | TM |
| 361 | 1095192.1 | 244 | 306 | forward 1 | TM |
| 361 | 1095192.1 | 175 | 231 | forward 1 | TM |
| 361 | 1095192.1 | 439 | 504 | forward 1 | SP |
| 361 | 1095192.1 | 244 | 312 | forward 1 | TM |
| 361 | 1095192.1 | 253 | 309 | forward 1 | TM |
| 361 | 1095192.1 | 733 | 804 | forward 1 | TM |
| 361 | 1095192.1 | 439 | 513 | forward 1 | SP |
| 361 | 1095192.1 | 466 | 525 | forward 1 | TM |
| 362 | 167559.1 | 572 | 640 | forward 2 | SP |
| 362 | 167559.1 | 1724 | 1783 | forward 2 | TM |
| 362 | 167559.1 | 1728 | 1784 | forward 3 | SP |
| 362 | 167559.1 | 572 | 661 | forward 2 | SP |
| 363 | 1383286.12 | 1121 | 1186 | forward 2 | SP |
| 363 | 1383286.12 | 3008 | 3064 | forward 2 | TM |

TABLE 4-continued

| SEQ ID NO | Template ID | Start | Stop | Frame | Hit Type |
|---|---|---|---|---|---|
| 363 | 1383286.12 | 1126 | 1203 | forward 1 | TM |
| 363 | 1383286.12 | 926 | 985 | forward 2 | SP |
| 363 | 1383286.12 | 1123 | 1185 | forward 1 | TM |
| 363 | 1383286.12 | 1123 | 1185 | forward 1 | TM |
| 363 | 1383286.12 | 1117 | 1176 | forward 1 | TM |
| 363 | 1383286.12 | 1123 | 1176 | forward 1 | TM |
| 365 | 53059.11 | 1597 | 1665 | forward 1 | SP |
| 366 | 337156.2 | 676 | 741 | forward 1 | TM |
| 366 | 337156.2 | 685 | 741 | forward 1 | TM |
| 366 | 337156.2 | 1168 | 1221 | forward 1 | SP |
| 366 | 337156.2 | 202 | 258 | forward 1 | TM |
| 366 | 337156.2 | 1951 | 2016 | forward 1 | SP |
| 366 | 337156.2 | 1993 | 2043 | forward 1 | TM |
| 366 | 337156.2 | 2053 | 2121 | forward 1 | TM |
| 366 | 337156.2 | 3056 | 3118 | forward 2 | TM |
| 366 | 337156.2 | 1168 | 1212 | forward 1 | SP |
| 366 | 337156.2 | 2050 | 2103 | forward 2 | TM |
| 366 | 337156.2 | 2823 | 2885 | forward 3 | TM |
| 366 | 337156.2 | 2053 | 2115 | forward 1 | TM |
| 366 | 337156.2 | 2062 | 2121 | forward 1 | TM |
| 371 | 994430.15 | 1255 | 1305 | forward 1 | TM |
| 377 | 3283554CD1 | 1 | 18 | | SP |
| 377 | 3283554CD1 | 1 | 22 | | SP |
| 377 | 3283554CD1 | 1 | 20 | | SP |
| 380 | 222956.22 | 824 | 886 | forward 2 | TM |
| 380 | 222956.22 | 680 | 754 | forward 2 | SP |
| 380 | 222956.22 | 707 | 769 | forward 2 | TM |
| 381 | 222956.24 | 1087 | 1143 | forward 1 | SP |
| 381 | 222956.24 | 1075 | 1143 | forward 1 | SP |
| 381 | 222956.24 | 1069 | 1143 | forward 1 | SP |
| 382 | 973308.1 | 1471 | 1536 | forward 1 | SP |
| 382 | 973308.1 | 1140 | 1262 | forward 3 | SP |
| 382 | 973308.1 | 1489 | 1542 | forward 1 | TM |
| 382 | 973308.1 | 1486 | 1545 | forward 1 | TM |
| 383 | 238026.4 | 771 | 815 | forward 3 | SP |
| 383 | 238026.4 | 765 | 851 | forward 3 | SP |
| 383 | 238026.4 | 765 | 827 | forward 3 | SP |
| 383 | 238026.4 | 765 | 836 | forward 3 | TM |
| 383 | 238026.4 | 759 | 812 | forward 3 | TM |
| 383 | 238026.4 | 765 | 839 | forward 3 | SP |
| 383 | 238026.4 | 789 | 845 | forward 3 | TM |
| 383 | 238026.4 | 759 | 842 | forward 3 | TM |
| 383 | 238026.4 | 771 | 836 | forward 3 | TM |
| 383 | 238026.4 | 765 | 827 | forward 3 | SP |
| 383 | 238026.4 | 771 | 827 | forward 3 | SP |
| 384 | 1094829.52 | 168 | 236 | forward 3 | SP |
| 384 | 1094829.52 | 1067 | 1156 | forward 2 | SP |
| 384 | 1094829.52 | 456 | 539 | forward 3 | SP |
| 385 | 1094829.54 | 1004 | 1072 | forward 2 | SP |
| 385 | 1094829.54 | 1802 | 1891 | forward 2 | SP |
| 385 | 1094829.54 | 1292 | 1375 | forward 2 | SP |
| 386 | 899802.1 | 1032 | 1115 | forward 3 | TM |
| 386 | 899802.1 | 808 | 882 | forward 1 | SP |
| 386 | 899802.1 | 808 | 873 | forward 1 | SP |
| 386 | 899802.1 | 808 | 870 | forward 1 | SP |
| 387 | 107569.15 | 2382 | 2435 | forward 3 | TM |
| 387 | 107569.15 | 3577 | 3630 | forward 1 | TM |
| 387 | 107569.15 | 2380 | 2457 | forward 1 | TM |
| 387 | 107569.15 | 2365 | 2433 | forward 1 | TM |
| 387 | 107569.15 | 3212 | 3292 | forward 2 | TM |
| 387 | 107569.15 | 3542 | 3610 | forward 2 | TM |
| 387 | 107569.15 | 3512 | 3574 | forward 2 | TM |
| 387 | 107569.15 | 3242 | 3295 | forward 2 | TM |
| 387 | 107569.15 | 2501 | 2557 | forward 2 | TM |
| 387 | 107569.15 | 3224 | 3289 | forward 2 | SP |
| 387 | 107569.15 | 3609 | 3692 | forward 3 | TM |
| 387 | 107569.15 | 3615 | 3674 | forward 3 | TM |
| 387 | 107569.15 | 1334 | 1408 | forward 2 | TM |
| 387 | 107569.15 | 1384 | 1440 | forward 1 | TM |
| 387 | 107569.15 | 3562 | 3636 | forward 1 | TM |
| 387 | 107569.15 | 3592 | 3651 | forward 1 | TM |
| 387 | 107569.15 | 3233 | 3292 | forward 2 | TM |
| 391 | 383863.2 | 3825 | 3884 | forward 3 | TM |
| 391 | 383863.2 | 1622 | 1672 | forward 2 | TM |
| 391 | 383863.2 | 1595 | 1651 | forward 2 | SP |
| 391 | 383863.2 | 1163 | 1216 | forward 2 | SP |
| 391 | 383863.2 | 4404 | 4472 | forward 3 | TM |
| 391 | 383863.2 | 1595 | 1666 | forward 2 | SP |
| 391 | 383863.2 | 1307 | 1360 | forward 2 | TM |
| 391 | 383863.2 | 1595 | 1654 | forward 2 | SP |
| 391 | 383863.2 | 1595 | 1663 | forward 2 | SP |
| 391 | 383863.2 | 3846 | 3899 | forward 3 | TM |
| 392 | 903491.4 | 551 | 604 | forward 2 | SP |
| 392 | 903491.4 | 1371 | 1421 | forward 3 | TM |
| 392 | 903491.4 | 1239 | 1295 | forward 3 | TM |
| 392 | 903491.4 | 1355 | 1411 | forward 2 | TM |
| 392 | 903491.4 | 789 | 845 | forward 3 | TM |
| 392 | 903491.4 | 1816 | 1878 | forward 1 | SP |
| 392 | 903491.4 | 1334 | 1405 | forward 2 | TM |
| 392 | 903491.4 | 1365 | 1421 | forward 3 | TM |
| 392 | 903491.4 | 1342 | 1419 | forward 1 | SP |
| 395 | 65367.1 | 559 | 615 | forward 1 | SP |
| 395 | 65367.1 | 477 | 533 | forward 3 | TM |
| 395 | 65367.1 | 491 | 565 | forward 2 | TM |
| 398 | 233513.2 | 1980 | 2048 | forward 3 | SP |
| 401 | 3676741CD1 | 45 | 66 | | SP |
| 402 | 346636.6 | 399 | 470 | forward 3 | SP |
| 404 | 1640555CD1 | 1 | 31 | | SP |
| 409 | 199584.1 | 1507 | 1563 | forward 1 | TM |
| 409 | 199584.1 | 2776 | 2835 | forward 1 | SP |
| 409 | 199584.1 | 1069 | 1143 | forward 1 | TM |
| 409 | 199584.1 | 1201 | 1245 | forward 1 | SP |
| 409 | 199584.1 | 1498 | 1557 | forward 1 | SP |
| 409 | 199584.1 | 2915 | 2992 | forward 2 | TM |
| 409 | 199584.1 | 1069 | 1125 | forward 1 | SP |
| 409 | 199584.1 | 1063 | 1146 | forward 1 | TM |
| 410 | 401736.1 | 385 | 462 | forward 1 | TM |
| 412 | 167854.1 | 679 | 732 | forward 1 | SP |
| 415 | 351432.23 | 1425 | 1499 | forward 3 | TM |
| 415 | 351432.23 | 689 | 751 | forward 2 | TM |
| 415 | 351432.23 | 990 | 1061 | forward 3 | TM |
| 415 | 351432.23 | 1422 | 1475 | forward 3 | SP |
| 415 | 351432.23 | 1476 | 1526 | forward 3 | TM |
| 415 | 351432.23 | 396 | 479 | forward 3 | SP |
| 415 | 351432.23 | 1410 | 1466 | forward 3 | TM |
| 415 | 351432.23 | 1410 | 1460 | forward 3 | SP |
| 415 | 351432.23 | 1035 | 1091 | forward 3 | TM |
| 415 | 351432.23 | 566 | 625 | forward 2 | SP |
| 415 | 351432.23 | 566 | 637 | forward 2 | SP |
| 415 | 351432.23 | 569 | 616 | forward 2 | TM |
| 415 | 351432.23 | 1410 | 1487 | forward 3 | SP |
| 415 | 351432.23 | 1410 | 1487 | forward 3 | SP |
| 415 | 351432.23 | 1410 | 1472 | forward 3 | SP |
| 415 | 351432.23 | 1410 | 1475 | forward 3 | SP |
| 415 | 351432.23 | 575 | 631 | forward 2 | TM |
| 415 | 351432.23 | 566 | 631 | forward 2 | SP |
| 419 | 2545475CD1 | 179 | 195 | | SP |
| 419 | 2545475CD1 | 263 | 287 | | TM |
| 419 | 2545475CD1 | 387 | 405 | | TM |
| 419 | 2545475CD1 | 176 | 195 | | TM |
| 419 | 2545475CD1 | 87 | 105 | | TM |
| 419 | 2545475CD1 | 421 | 438 | | TM |
| 419 | 2545475CD1 | 425 | 443 | | TM |
| 422 | 220134.6 | 2434 | 2484 | forward 1 | TM |
| 422 | 220134.6 | 2684 | 2737 | forward 2 | TM |
| 422 | 220134.6 | 1417 | 1473 | forward 1 | TM |
| 422 | 220134.6 | 2687 | 2749 | forward 2 | TM |
| 422 | 220134.6 | 1605 | 1679 | forward 3 | SP |
| 422 | 220134.6 | 2699 | 2758 | forward 2 | SP |
| 422 | 220134.6 | 2699 | 2752 | forward 2 | SP |
| 422 | 220134.6 | 2444 | 2527 | forward 2 | TM |
| 422 | 220134.6 | 2699 | 2764 | forward 2 | SP |
| 422 | 220134.6 | 2709 | 2771 | forward 3 | TM |
| 422 | 220134.6 | 2699 | 2752 | forward 2 | SP |
| 423 | 220134.5 | 847 | 900 | forward 1 | TM |
| 423 | 220134.5 | 850 | 912 | forward 1 | TM |
| 423 | 220134.5 | 862 | 921 | forward 1 | SP |
| 423 | 220134.5 | 862 | 915 | forward 1 | SP |
| 423 | 220134.5 | 872 | 934 | forward 2 | TM |
| 423 | 220134.5 | 607 | 690 | forward 1 | TM |
| 423 | 220134.5 | 862 | 927 | forward 1 | SP |
| 423 | 220134.5 | 862 | 915 | forward 1 | SP |
| 424 | 202164.1 | 215 | 268 | forward 2 | TM |
| 424 | 202164.1 | 2996 | 3046 | forward 2 | SP |

TABLE 4-continued

| SEQ ID NO | Template ID | Start | Stop | Frame | Hit Type |
|---|---|---|---|---|---|
| 424 | 202164.1 | 1976 | 2035 | forward 2 | TM |
| 424 | 202164.1 | 1286 | 1342 | forward 2 | SP |
| 424 | 202164.1 | 2990 | 3076 | forward 2 | TM |
| 424 | 202164.1 | 1975 | 2034 | forward 1 | TM |
| 424 | 202164.1 | 236 | 298 | forward 2 | SP |
| 424 | 202164.1 | 2393 | 2440 | forward 2 | TM |
| 424 | 202164.1 | 236 | 289 | forward 2 | SP |
| 425 | 406846.4 | 752 | 817 | forward 2 | TM |
| 425 | 406846.4 | 510 | 572 | forward 3 | TM |
| 425 | 406846.4 | 831 | 881 | forward 3 | TM |
| 425 | 406846.4 | 628 | 681 | forward 1 | TM |
| 425 | 406846.4 | 780 | 842 | forward 3 | TM |
| 425 | 406846.4 | 646 | 711 | forward 1 | SP |
| 425 | 406846.4 | 429 | 515 | forward 3 | TM |
| 425 | 406846.4 | 498 | 560 | forward 3 | TM |
| 425 | 406846.4 | 607 | 669 | forward 1 | SP |
| 425 | 406846.4 | 411 | 473 | forward 3 | TM |
| 425 | 406846.4 | 498 | 551 | forward 3 | TM |
| 430 | 1273292CD1 | 1 | 22 | | SP |
| 431 | 67855.1 | 190 | 258 | forward 1 | SP |
| 431 | 67855.1 | 41 | 97 | forward 2 | SP |
| 431 | 67855.1 | 190 | 240 | forward 1 | SP |
| 431 | 67855.1 | 294 | 359 | forward 3 | SP |
| 431 | 67855.1 | 41 | 109 | forward 2 | SP |
| 432 | 27185.1 | 461 | 532 | forward 2 | TM |
| 435 | 17021.2 | 40 | 102 | forward 1 | TM |
| 435 | 17021.2 | 31 | 84 | forward 1 | TM |
| 435 | 17021.2 | 31 | 96 | forward 1 | TM |
| 440 | 337647.1 | 477 | 533 | forward 3 | TM |
| 441 | 200268.3 | 250 | 303 | forward 1 | TM |
| 441 | 200268.3 | 1214 | 1264 | forward 2 | SP |
| 441 | 200268.3 | 970 | 1026 | forward 1 | SP |
| 441 | 200268.3 | 958 | 1029 | forward 1 | SP |
| 441 | 200268.3 | 1214 | 1288 | forward 2 | SP |
| 441 | 200268.3 | 1214 | 1267 | forward 2 | SP |
| 441 | 200268.3 | 1214 | 1282 | forward 2 | SP |
| 441 | 200268.3 | 1854 | 1931 | forward 3 | SP |
| 441 | 200268.3 | 1214 | 1267 | forward 2 | TM |
| 441 | 200268.3 | 958 | 1026 | forward 1 | SP |
| 444 | 334738.1 | 55 | 141 | forward 1 | SP |
| 445 | 410042.1 | 2854 | 2910 | forward 1 | TM |
| 447 | 2026270CD1 | 1 | 24 | | SP |
| 447 | 2026270CD1 | 1 | 25 | | SP |
| 449 | 522433CD1 | 14 | 31 | | SP |
| 449 | 522433CD1 | 14 | 33 | | SP |
| 449 | 522433CD1 | 6 | 31 | | SP |
| 449 | 522433CD1 | 1 | 29 | | SP |
| 456 | 3105671CD1 | 1 | 18 | | SP |
| 456 | 3105671CD1 | 1 | 20 | | SP |
| 458 | 2051966CD1 | 1 | 22 | | SP |
| 458 | 2051966CD1 | 1 | 19 | | SP |
| 462 | 2171401CD1 | 1 | 21 | | SP |
| 462 | 2171401CD1 | 1 | 23 | | SP |
| 463 | 1326983.14 | 598 | 666 | forward 1 | TM |
| 463 | 1326983.14 | 927 | 983 | forward 3 | TM |
| 463 | 1326983.14 | 1751 | 1813 | forward 2 | SP |
| 463 | 1326983.14 | 117 | 203 | forward 3 | TM |
| 463 | 1326983.14 | 4034 | 4078 | forward 2 | SP |
| 463 | 1326983.14 | 1340 | 1399 | forward 2 | TM |
| 463 | 1326983.14 | 1751 | 1807 | forward 2 | SP |
| 463 | 1326983.14 | 1325 | 1387 | forward 2 | SP |
| 463 | 1326983.14 | 1769 | 1837 | forward 2 | TM |
| 463 | 1326983.14 | 1325 | 1399 | forward 2 | SP |
| 463 | 1326983.14 | 143 | 202 | forward 2 | TM |
| 463 | 1326983.14 | 4228 | 4290 | forward 1 | TM |
| 463 | 1326983.14 | 1598 | 1675 | forward 2 | TM |
| 463 | 1326983.14 | 1325 | 1378 | forward 2 | SP |
| 463 | 1326983.14 | 1769 | 1831 | forward 2 | TM |
| 463 | 1326983.14 | 1463 | 1525 | forward 2 | TM |
| 463 | 1326983.14 | 1751 | 1816 | forward 2 | SP |
| 463 | 1326983.14 | 1022 | 1081 | forward 2 | TM |
| 463 | 1326983.14 | 1436 | 1504 | forward 2 | TM |
| 463 | 1326983.14 | 1325 | 1390 | forward 2 | SP |
| 463 | 1326983.14 | 1457 | 1534 | forward 2 | TM |
| 463 | 1326983.14 | 1460 | 1522 | forward 2 | TM |
| 463 | 1326983.14 | 1475 | 1528 | forward 2 | TM |
| 463 | 1326983.14 | 118 | 195 | forward 1 | TM |
| 463 | 1326983.14 | 1751 | 1825 | forward 2 | SP |
| 465 | 331666.1 | 976 | 1029 | forward 1 | TM |
| 465 | 331666.1 | 153 | 239 | forward 3 | SP |
| 468 | 409895.2 | 384 | 437 | forward 3 | SP |
| 469 | 245136.9 | 1343 | 1417 | forward 2 | SP |
| 469 | 245136.9 | 1352 | 1417 | forward 2 | SP |
| 469 | 245136.9 | 1369 | 1422 | forward 1 | TM |
| 469 | 245136.9 | 1364 | 1423 | forward 2 | SP |
| 469 | 245136.9 | 1325 | 1387 | forward 2 | TM |
| 469 | 245136.9 | 1364 | 1417 | forward 2 | SP |
| 469 | 245136.9 | 1364 | 1411 | forward 2 | SP |
| 469 | 245136.9 | 1355 | 1411 | forward 2 | TM |
| 474 | 900070.12 | 1702 | 1749 | forward 1 | TM |
| 474 | 900070.12 | 2271 | 2324 | forward 3 | SP |
| 475 | 231182.1 | 944 | 997 | forward 2 | TM |
| 479 | 1256053CD1 | 9 | 23 | | SP |
| 479 | 1256053CD1 | 9 | 27 | | SP |
| 479 | 1256053CD1 | 9 | 29 | | SP |
| 479 | 1256053CD1 | 9 | 30 | | SP |
| 479 | 1256053CD1 | 9 | 32 | | SP |
| 479 | 1256053CD1 | 1 | 32 | | SP |
| 480 | 238391.3 | 44 | 97 | forward 2 | TM |
| 480 | 238391.3 | 954 | 1040 | forward 3 | SP |
| 480 | 238391.3 | 194 | 262 | forward 2 | TM |
| 480 | 238391.3 | 255 | 341 | forward 3 | SP |
| 480 | 238391.3 | 302 | 370 | forward 2 | SP |
| 480 | 238391.3 | 185 | 244 | forward 2 | SP |
| 480 | 238391.3 | 188 | 259 | forward 2 | TM |
| 480 | 238391.3 | 200 | 256 | forward 2 | TM |
| 480 | 238391.3 | 287 | 358 | forward 2 | TM |
| 480 | 238391.3 | 287 | 361 | forward 2 | SP |
| 480 | 238391.3 | 287 | 370 | forward 2 | SP |
| 480 | 238391.3 | 302 | 358 | forward 2 | TM |
| 480 | 238391.3 | 161 | 223 | forward 2 | TM |
| 481 | 201945.4 | 1104 | 1169 | forward 3 | SP |
| 484 | 998941.1 | 2607 | 2663 | forward 3 | TM |
| 484 | 998941.1 | 2947 | 3027 | forward 1 | TM |
| 484 | 998941.1 | 2261 | 2335 | forward 2 | TM |
| 484 | 998941.1 | 947 | 1006 | forward 2 | SP |
| 484 | 998941.1 | 1776 | 1826 | forward 3 | TM |
| 484 | 998941.1 | 1277 | 1333 | forward 2 | SP |
| 484 | 998941.1 | 1131 | 1187 | forward 3 | SP |
| 484 | 998941.1 | 2334 | 2402 | forward 3 | TM |
| 484 | 998941.1 | 1277 | 1336 | forward 2 | SP |
| 484 | 998941.1 | 3745 | 3807 | forward 1 | TM |
| 484 | 998941.1 | 3473 | 3538 | forward 2 | TM |
| 484 | 998941.1 | 3757 | 3810 | forward 1 | TM |
| 484 | 998941.1 | 3316 | 3378 | forward 1 | TM |
| 484 | 998941.1 | 2485 | 2544 | forward 1 | TM |
| 484 | 998941.1 | 3319 | 3381 | forward 1 | TM |
| 484 | 998941.1 | 2276 | 2332 | forward 2 | TM |
| 484 | 998941.1 | 2476 | 2544 | forward 1 | TM |
| 484 | 998941.1 | 3313 | 3363 | forward 1 | TM |
| 484 | 998941.1 | 4277 | 4333 | forward 2 | SP |
| 484 | 998941.1 | 3301 | 3375 | forward 1 | TM |
| 484 | 998941.1 | 2337 | 2396 | forward 3 | TM |
| 484 | 998941.1 | 3757 | 3816 | forward 1 | TM |
| 484 | 998941.1 | 2334 | 2396 | forward 3 | TM |
| 484 | 998941.1 | 3319 | 3375 | forward 1 | TM |
| 485 | 243985.1 | 1887 | 1961 | forward 3 | SP |
| 485 | 243985.1 | 1202 | 1270 | forward 2 | SP |
| 486 | 481779.1 | 650 | 706 | forward 2 | TM |
| 489 | 2120743CD1 | 60 | 78 | | SP |
| 489 | 2120743CD1 | 36 | 54 | | TM |
| 489 | 2120743CD1 | 125 | 142 | | TM |
| 489 | 2120743CD1 | 87 | 112 | | SP |
| 489 | 2120743CD1 | 189 | 219 | | SP |
| 489 | 2120743CD1 | 381 | 398 | | TM |
| 489 | 2120743CD1 | 344 | 374 | | SP |
| 489 | 2120743CD1 | 295 | 323 | | TM |
| 489 | 2120743CD1 | 292 | 312 | | TM |
| 489 | 2120743CD1 | 290 | 307 | | TM |
| 489 | 2120743CD1 | 196 | 215 | | SP |
| 489 | 2120743CD1 | 198 | 214 | | TM |
| 489 | 2120743CD1 | 87 | 113 | | SP |
| 489 | 2120743CD1 | 172 | 190 | | SP |
| 489 | 2120743CD1 | 301 | 319 | | TM |

TABLE 4-continued

| SEQ ID NO | Template ID | Start | Stop | Frame | Hit Type |
|---|---|---|---|---|---|
| 489 | 2120743CD1 | 349 | 371 | | SP |
| 489 | 2120743CD1 | 172 | 188 | | SP |
| 489 | 2120743CD1 | 196 | 220 | | SP |
| 489 | 2120743CD1 | 63 | 80 | | TM |
| 489 | 2120743CD1 | 177 | 192 | | TM |
| 489 | 2120743CD1 | 196 | 218 | | SP |
| 489 | 2120743CD1 | 63 | 83 | | TM |
| 489 | 2120743CD1 | 298 | 320 | | TM |
| 489 | 2120743CD1 | 61 | 83 | | TM |
| 489 | 2120743CD1 | 64 | 83 | | TM |
| 489 | 2120743CD1 | 62 | 84 | | TM |
| 491 | 199121.14 | 645 | 719 | forward 3 | SP |
| 491 | 199121.14 | 1877 | 1927 | forward 2 | TM |
| 491 | 199121.14 | 1853 | 1921 | forward 2 | SP |
| 491 | 199121.14 | 1859 | 1930 | forward 2 | TM |
| 491 | 199121.14 | 453 | 515 | forward 3 | SP |
| 491 | 199121.14 | 3446 | 3505 | forward 2 | TM |
| 491 | 199121.14 | 1874 | 1942 | forward 2 | TM |
| 491 | 199121.14 | 1877 | 1939 | forward 2 | TM |
| 491 | 199121.14 | 9 | 59 | forward 3 | SP |
| 491 | 199121.14 | 1877 | 1936 | forward 2 | TM |
| 495 | 206866.1 | 2463 | 2516 | forward 3 | TM |
| 495 | 206866.1 | 1095 | 1148 | forward 3 | SP |
| 495 | 206866.1 | 1960 | 2040 | forward 1 | TM |
| 495 | 206866.1 | 1971 | 2042 | forward 3 | TM |
| 495 | 206866.1 | 1857 | 1904 | forward 3 | TM |
| 495 | 206866.1 | 1857 | 1916 | forward 3 | TM |
| 495 | 206866.1 | 1860 | 1934 | forward 3 | TM |
| 495 | 206866.1 | 1966 | 2025 | forward 1 | TM |
| 496 | 1330257.51 | 2028 | 2096 | forward 3 | SP |
| 497 | 983942.1 | 1005 | 1103 | forward 3 | SP |
| 500 | 303545.3 | 284 | 346 | forward 2 | SP |
| 500 | 303545.3 | 239 | 322 | forward 2 | TM |
| 500 | 303545.3 | 284 | 349 | forward 2 | SP |
| 500 | 303545.3 | 284 | 355 | forward 2 | SP |
| 503 | 2246292CD1 | 82 | 98 | | TM |
| 503 | 2246292CD1 | 76 | 97 | | SP |
| 503 | 2246292CD1 | 222 | 247 | | SP |
| 503 | 2246292CD1 | 328 | 347 | | TM |
| 503 | 2246292CD1 | 1 | 21 | | SP |
| 503 | 2246292CD1 | 1 | 23 | | SP |
| 503 | 2246292CD1 | 185 | 204 | | TM |
| 503 | 2246292CD1 | 222 | 240 | | SP |
| 503 | 2246292CD1 | 222 | 244 | | SP |
| 503 | 2246292CD1 | 222 | 242 | | SP |
| 503 | 2246292CD1 | 85 | 104 | | TM |
| 504 | 411449.1 | 2699 | 2770 | forward 2 | SP |
| 504 | 411449.1 | 2695 | 2751 | forward 1 | TM |
| 504 | 411449.1 | 1337 | 1390 | forward 2 | TM |
| 504 | 411449.1 | 2995 | 3051 | forward 1 | TM |
| 504 | 411449.1 | 1344 | 1406 | forward 3 | SP |
| 504 | 411449.1 | 2756 | 2824 | forward 2 | SP |
| 504 | 411449.1 | 2764 | 2838 | forward 1 | SP |
| 504 | 411449.1 | 2729 | 2803 | forward 2 | TM |
| 504 | 411449.1 | 3049 | 3129 | forward 1 | TM |
| 504 | 411449.1 | 2717 | 2770 | forward 2 | SP |
| 504 | 411449.1 | 2753 | 2842 | forward 2 | SP |
| 504 | 411449.1 | 2771 | 2827 | forward 2 | TM |
| 504 | 411449.1 | 3052 | 3105 | forward 1 | TM |
| 504 | 411449.1 | 2768 | 2821 | forward 2 | TM |
| 504 | 411449.1 | 2765 | 2827 | forward 2 | SP |
| 504 | 411449.1 | 2764 | 2832 | forward 1 | SP |
| 504 | 411449.1 | 2999 | 3055 | forward 2 | TM |
| 504 | 411449.1 | 3055 | 3111 | forward 1 | TM |
| 504 | 411449.1 | 3028 | 3099 | forward 1 | TM |
| 504 | 411449.1 | 2731 | 2802 | forward 1 | TM |
| 505 | 409853.3 | 1299 | 1379 | forward 3 | TM |
| 505 | 409853.3 | 1040 | 1105 | forward 2 | SP |
| 505 | 409853.3 | 2537 | 2605 | forward 2 | SP |
| 505 | 409853.3 | 1048 | 1104 | forward 1 | TM |
| 505 | 409853.3 | 2537 | 2596 | forward 2 | SP |
| 505 | 409853.3 | 1040 | 1087 | forward 2 | SP |
| 505 | 409853.3 | 1037 | 1096 | forward 2 | TM |
| 505 | 409853.3 | 1040 | 1096 | forward 2 | SP |
| 505 | 409853.3 | 2546 | 2602 | forward 2 | TM |
| 505 | 409853.3 | 1040 | 1102 | forward 2 | SP |
| 505 | 409853.3 | 2515 | 2562 | forward 1 | SP |
| 510 | 14538.1 | 341 | 388 | forward 2 | SP |
| 512 | 239996.2 | 251 | 322 | forward 2 | TM |
| 513 | 238403.2 | 628 | 717 | forward 1 | SP |
| 513 | 238403.2 | 585 | 683 | forward 3 | SP |
| 513 | 238403.2 | 2251 | 2310 | forward 1 | TM |
| 513 | 238403.2 | 628 | 690 | forward 1 | SP |
| 514 | 234681.2 | 203 | 292 | forward 2 | SP |
| 514 | 234681.2 | 762 | 821 | forward 3 | TM |
| 514 | 234681.2 | 1918 | 1974 | forward 1 | SP |
| 514 | 234681.2 | 1243 | 1317 | forward 1 | TM |
| 514 | 234681.2 | 203 | 277 | forward 2 | SP |
| 514 | 234681.2 | 1184 | 1252 | forward 2 | TM |
| 514 | 234681.2 | 1221 | 1301 | forward 3 | TM |
| 515 | 228678.1 | 610 | 663 | forward 1 | TM |
| 517 | 233218.18 | 720 | 785 | forward 3 | SP |
| 517 | 233218.18 | 356 | 433 | forward 2 | SP |
| 517 | 233218.18 | 356 | 421 | forward 2 | SP |
| 517 | 233218.18 | 356 | 418 | forward 2 | SP |
| 517 | 233218.18 | 720 | 779 | forward 3 | SP |
| 517 | 233218.18 | 356 | 430 | forward 2 | SP |
| 518 | 6320.1 | 289 | 360 | forward 1 | SP |
| 518 | 6320.1 | 194 | 268 | forward 2 | SP |
| 519 | 15433.1 | 91 | 174 | forward 1 | TM |
| 521 | 1600311CD1 | 51 | 68 | | TM |
| 522 | 335999.1 | 243 | 314 | forward 3 | SP |
| 522 | 335999.1 | 258 | 326 | forward 3 | SP |
| 522 | 335999.1 | 219 | 296 | forward 3 | TM |
| 522 | 335999.1 | 233 | 307 | forward 2 | TM |
| 522 | 335999.1 | 252 | 308 | forward 3 | TM |
| 522 | 335999.1 | 251 | 304 | forward 2 | TM |
| 522 | 335999.1 | 242 | 304 | forward 1 | TM |
| 522 | 335999.1 | 255 | 308 | forward 3 | TM |
| 523 | 197523.6 | 422 | 487 | forward 2 | SP |
| 523 | 197523.6 | 64 | 123 | forward 1 | SP |
| 523 | 197523.6 | 434 | 508 | forward 2 | TM |
| 523 | 197523.6 | 97 | 150 | forward 1 | TM |
| 523 | 197523.6 | 434 | 496 | forward 2 | TM |
| 527 | 2239738CD1 | 1 | 19 | | SP |
| 527 | 2239738CD1 | 1 | 24 | | SP |
| 527 | 2239738CD1 | 1 | 17 | | SP |
| 528 | 87074.1 | 1324 | 1377 | forward 1 | TM |
| 528 | 87074.1 | 2545 | 2601 | forward 1 | TM |
| 528 | 87074.1 | 1334 | 1390 | forward 2 | TM |
| 528 | 87074.1 | 2520 | 2594 | forward 3 | TM |
| 528 | 87074.1 | 1309 | 1380 | forward 1 | TM |
| 528 | 87074.1 | 1230 | 1283 | forward 3 | TM |
| 528 | 87074.1 | 1303 | 1371 | forward 1 | TM |
| 528 | 87074.1 | 2639 | 2710 | forward 2 | TM |
| 528 | 87074.1 | 1315 | 1371 | forward 1 | TM |
| 528 | 87074.1 | 2541 | 2600 | forward 3 | TM |
| 531 | 1730175CD1 | 1104 | 1119 | | SP |
| 531 | 1730175CD1 | 1102 | 1129 | | TM |
| 531 | 1730175CD1 | 1 | 30 | | SP |
| 531 | 1730175CD1 | 1107 | 1129 | | TM |
| 531 | 1730175CD1 | 1104 | 1124 | | TM |
| 531 | 1730175CD1 | 1104 | 1121 | | TM |
| 531 | 1730175CD1 | 1104 | 1123 | | TM |
| 531 | 1730175CD1 | 1104 | 1126 | | TM |
| 533 | 6825202CD1 | 478 | 496 | | SP |
| 533 | 6825202CD1 | 16 | 36 | | SP |
| 533 | 6825202CD1 | 15 | 36 | | SP |
| 533 | 6825202CD1 | 12 | 36 | | SP |
| 533 | 6825202CD1 | 1 | 36 | | SP |
| 537 | 480736.41 | 1612 | 1683 | forward 1 | TM |
| 538 | 236943.1 | 855 | 908 | forward 3 | TM |
| 539 | 76636.1 | 215 | 280 | forward 2 | SP |
| 540 | 76644.1 | 218 | 289 | forward 2 | SP |
| 540 | 76644.1 | 351 | 404 | forward 3 | TM |
| 540 | 76644.1 | 197 | 283 | forward 2 | TM |
| 541 | 76699.1 | 533 | 586 | forward 2 | SP |
| 541 | 76699.1 | 533 | 595 | forward 2 | SP |
| 541 | 76699.1 | 533 | 583 | forward 2 | SP |
| 541 | 76699.1 | 537 | 593 | forward 3 | TM |
| 541 | 76699.1 | 533 | 589 | forward 2 | TM |
| 543 | 19080.2 | 913 | 975 | forward 1 | SP |
| 543 | 19080.2 | 910 | 966 | forward 1 | TM |
| 544 | 274444.1 | 114 | 182 | forward 3 | SP |

TABLE 4-continued

| SEQ ID NO | Template ID | Start | Stop | Frame | Hit Type |
|---|---|---|---|---|---|
| 544 | 274444.1 | 138 | 233 | forward 3 | SP |
| 546 | 1330220.16 | 970 | 1053 | forward 1 | SP |
| 546 | 1330220.16 | 2624 | 2677 | forward 2 | SP |
| 546 | 1330220.16 | 2603 | 2662 | forward 2 | TM |
| 546 | 1330220.16 | 557 | 610 | forward 1 | TM |
| 546 | 1330220.16 | 4702 | 4788 | forward 1 | SP |
| 546 | 1330220.16 | 976 | 1029 | forward 1 | TM |
| 546 | 1330220.16 | 2618 | 2677 | forward 2 | SP |
| 546 | 1330220.16 | 970 | 1053 | forward 1 | SP |
| 546 | 1330220.16 | 3609 | 3677 | forward 3 | SP |
| 546 | 1330220.16 | 551 | 607 | forward 2 | TM |
| 547 | 99792.1 | 657 | 710 | forward 3 | TM |
| 550 | 238396.1 | 1136 | 1213 | forward 2 | TM |
| 550 | 238396.1 | 1172 | 1225 | forward 2 | TM |
| 550 | 238396.1 | 936 | 998 | forward 3 | SP |
| 551 | 23904.1 | 392 | 463 | forward 2 | TM |
| 551 | 23904.1 | 431 | 493 | forward 2 | TM |
| 551 | 23904.1 | 150 | 203 | forward 3 | TM |
| 551 | 23904.1 | 773 | 847 | forward 2 | TM |
| 551 | 23904.1 | 156 | 212 | forward 3 | TM |
| 551 | 23904.1 | 782 | 841 | forward 2 | TM |
| 552 | 274712.1 | 1985 | 2044 | forward 2 | TM |
| 552 | 274712.1 | 2883 | 2966 | forward 3 | TM |
| 552 | 274712.1 | 1942 | 2004 | forward 1 | TM |
| 552 | 274712.1 | 1589 | 1645 | forward 2 | TM |
| 552 | 274712.1 | 2925 | 2978 | forward 3 | TM |
| 552 | 274712.1 | 2907 | 2969 | forward 3 | TM |
| 552 | 274712.1 | 2655 | 2729 | forward 3 | TM |
| 552 | 274712.1 | 590 | 655 | forward 2 | SP |
| 552 | 274712.1 | 2661 | 2717 | forward 3 | TM |
| 552 | 274712.1 | 2895 | 2951 | forward 3 | TM |
| 552 | 274712.1 | 2907 | 2978 | forward 3 | TM |
| 553 | 979567.11 | 4850 | 4918 | forward 2 | TM |
| 553 | 979567.11 | 3137 | 3199 | forward 2 | TM |
| 553 | 979567.11 | 3113 | 3190 | forward 2 | TM |
| 553 | 979567.11 | 284 | 352 | forward 2 | TM |
| 553 | 979567.11 | 1279 | 1341 | forward 1 | SP |
| 553 | 979567.11 | 7904 | 7972 | forward 2 | TM |
| 553 | 979567.11 | 7829 | 7894 | forward 2 | TM |
| 553 | 979567.11 | 7606 | 7659 | forward 1 | TM |
| 553 | 979567.11 | 7826 | 7891 | forward 2 | TM |
| 553 | 979567.11 | 871 | 933 | forward 1 | SP |
| 553 | 979567.11 | 885 | 938 | forward 3 | TM |
| 553 | 979567.11 | 3116 | 3181 | forward 2 | SP |
| 553 | 979567.11 | 873 | 932 | forward 3 | TM |
| 553 | 979567.11 | 7832 | 7888 | forward 2 | TM |
| 554 | 234121.1 | 151 | 213 | forward 1 | SP |
| 554 | 234121.1 | 2421 | 2477 | forward 3 | TM |
| 554 | 234121.1 | 2772 | 2858 | forward 3 | SP |
| 554 | 234121.1 | 2194 | 2277 | forward 1 | TM |
| 554 | 234121.1 | 2203 | 2250 | forward 1 | SP |
| 554 | 234121.1 | 1651 | 1716 | forward 1 | TM |
| 554 | 234121.1 | 2203 | 2268 | forward 1 | SP |
| 554 | 234121.1 | 2203 | 2259 | forward 1 | SP |
| 554 | 234121.1 | 2216 | 2278 | forward 2 | TM |
| 554 | 234121.1 | 2197 | 2265 | forward 1 | TM |
| 554 | 234121.1 | 2203 | 2289 | forward 1 | SP |
| 554 | 234121.1 | 2490 | 2543 | forward 3 | TM |
| 554 | 234121.1 | 2203 | 2259 | forward 1 | TM |
| 554 | 234121.1 | 2203 | 2256 | forward 1 | TM |
| 555 | 252493.15 | 902 | 958 | forward 2 | TM |
| 555 | 252493.15 | 498 | 554 | forward 3 | TM |
| 555 | 252493.15 | 498 | 551 | forward 3 | SP |
| 555 | 252493.15 | 3336 | 3398 | forward 3 | SP |
| 555 | 252493.15 | 3867 | 3917 | forward 3 | TM |
| 555 | 252493.15 | 1988 | 2068 | forward 2 | TM |
| 555 | 252493.15 | 906 | 989 | forward 3 | TM |
| 555 | 252493.15 | 2000 | 2062 | forward 2 | TM |
| 555 | 252493.15 | 498 | 545 | forward 3 | SP |
| 555 | 252493.15 | 900 | 953 | forward 3 | TM |
| 555 | 252493.15 | 1988 | 2044 | forward 2 | TM |
| 555 | 252493.15 | 498 | 560 | forward 3 | SP |
| 555 | 252493.15 | 903 | 977 | forward 3 | TM |
| 555 | 252493.15 | 909 | 968 | forward 3 | TM |
| 557 | 247423.13 | 2513 | 2593 | forward 2 | SP |
| 557 | 247423.13 | 3395 | 3460 | forward 2 | SP |
| 557 | 247423.13 | 3389 | 3451 | forward 2 | TM |
| 557 | 247423.13 | 4523 | 4588 | forward 2 | SP |
| 557 | 247423.13 | 4333 | 4419 | forward 1 | SP |
| 557 | 247423.13 | 5100 | 5168 | forward 3 | TM |
| 557 | 247423.13 | 4523 | 4576 | forward 2 | SP |
| 557 | 247423.13 | 659 | 730 | forward 2 | SP |
| 557 | 247423.13 | 3371 | 3457 | forward 2 | TM |
| 557 | 247423.13 | 3395 | 3448 | forward 2 | SP |
| 557 | 247423.13 | 5106 | 5168 | forward 3 | TM |
| 557 | 247423.13 | 3389 | 3451 | forward 2 | TM |
| 557 | 247423.13 | 3395 | 3442 | forward 2 | SP |
| 557 | 247423.13 | 3395 | 3454 | forward 2 | SP |
| 557 | 247423.13 | 3386 | 3451 | forward 2 | TM |
| 557 | 247423.13 | 2513 | 2587 | forward 2 | SP |
| 557 | 247423.13 | 3383 | 3433 | forward 2 | TM |
| 557 | 247423.13 | 3395 | 3454 | forward 2 | TM |
| 558 | 334234.2 | 926 | 1009 | forward 2 | SP |
| 558 | 334234.2 | 1558 | 1614 | forward 1 | TM |
| 559 | 205672.1 | 1836 | 1919 | forward 3 | TM |
| 559 | 205672.1 | 1857 | 1910 | forward 3 | TM |
| 559 | 205672.1 | 1848 | 1910 | forward 3 | TM |
| 559 | 205672.1 | 1869 | 1943 | forward 3 | TM |
| 560 | 1327024.5 | 4567 | 4620 | forward 1 | SP |
| 560 | 1327024.5 | 7801 | 7860 | forward 1 | TM |
| 560 | 1327024.5 | 7359 | 7409 | forward 3 | TM |
| 560 | 1327024.5 | 2893 | 2949 | forward 1 | SP |
| 560 | 1327024.5 | 5923 | 5979 | forward 1 | TM |
| 560 | 1327024.5 | 7792 | 7842 | forward 1 | TM |
| 560 | 1327024.5 | 8235 | 8288 | forward 3 | TM |
| 560 | 1327024.5 | 8289 | 8333 | forward 3 | TM |
| 560 | 1327024.5 | 6775 | 6834 | forward 1 | SP |
| 560 | 1327024.5 | 3580 | 3669 | forward 1 | SP |
| 560 | 1327024.5 | 6775 | 6846 | forward 1 | SP |
| 560 | 1327024.5 | 7135 | 7191 | forward 1 | TM |
| 560 | 1327024.5 | 6739 | 6855 | forward 1 | SP |
| 560 | 1327024.5 | 73 | 156 | forward 1 | SP |
| 560 | 1327024.5 | 8223 | 8303 | forward 3 | TM |
| 560 | 1327024.5 | 8232 | 8303 | forward 3 | TM |
| 560 | 1327024.5 | 8274 | 8336 | forward 3 | TM |
| 560 | 1327024.5 | 8241 | 8300 | forward 3 | TM |
| 562 | 2925789CD1 | 22 | 41 | | TM |
| 562 | 2925789CD1 | 185 | 215 | | SP |
| 562 | 2925789CD1 | 141 | 158 | | SP |
| 562 | 2925789CD1 | 206 | 224 | | TM |
| 562 | 2925789CD1 | 205 | 226 | | TM |
| 562 | 2925789CD1 | 145 | 170 | | TM |
| 563 | 335613.1 | 724 | 780 | forward 1 | TM |
| 564 | 207646.1 | 315 | 377 | forward 3 | TM |
| 564 | 207646.1 | 19 | 69 | forward 1 | TM |
| 564 | 207646.1 | 282 | 353 | forward 3 | SP |
| 564 | 207646.1 | 294 | 350 | forward 3 | SP |
| 564 | 207646.1 | 294 | 368 | forward 3 | TM |
| 564 | 207646.1 | 300 | 368 | forward 3 | TM |
| 566 | 1720847CD1 | 22 | 47 | | SP |
| 566 | 1720847CD1 | 22 | 42 | | TM |
| 569 | 107939.2 | 2634 | 2705 | forward 3 | SP |
| 569 | 107939.2 | 2936 | 2992 | forward 2 | TM |
| 569 | 107939.2 | 2942 | 2992 | forward 2 | TM |
| 569 | 107939.2 | 3776 | 3847 | forward 2 | TM |
| 569 | 107939.2 | 2939 | 3004 | forward 2 | SP |
| 572 | 207778.1 | 145 | 198 | forward 1 | SP |
| 572 | 207778.1 | 589 | 660 | forward 1 | SP |
| 572 | 207778.1 | 152 | 214 | forward 2 | TM |
| 573 | 296811.1 | 320 | 391 | forward 2 | SP |
| 573 | 296811.1 | 308 | 391 | forward 2 | SP |
| 573 | 296811.1 | 3141 | 3197 | forward 3 | TM |
| 573 | 296811.1 | 3424 | 3486 | forward 1 | SP |
| 573 | 296811.1 | 3163 | 3222 | forward 1 | TM |
| 573 | 296811.1 | 2136 | 2216 | forward 3 | SP |
| 573 | 296811.1 | 3142 | 3213 | forward 1 | TM |
| 573 | 296811.1 | 1680 | 1775 | forward 3 | SP |
| 574 | 333776.1 | 115 | 168 | forward 1 | TM |
| 578 | 110960CD1 | 185 | 213 | | SP |
| 578 | 110960CD1 | 108 | 126 | | TM |
| 578 | 110960CD1 | 102 | 127 | | TM |
| 578 | 110960CD1 | 105 | 125 | | TM |
| 578 | 110960CD1 | 289 | 314 | | TM |

TABLE 4-continued

| SEQ ID NO | Template ID | Start | Stop | Frame | Hit Type |
|---|---|---|---|---|---|
| 578 | 110960CD1 | 106 | 121 | | TM |
| 578 | 110960CD1 | 225 | 250 | | TM |
| 578 | 110960CD1 | 232 | 255 | | SP |
| 578 | 110960CD1 | 162 | 180 | | SP |
| 578 | 110960CD1 | 232 | 258 | | SP |
| 578 | 110960CD1 | 226 | 244 | | TM |
| 578 | 110960CD1 | 197 | 214 | | TM |
| 578 | 110960CD1 | 184 | 210 | | TM |
| 579 | 238602.2 | 57 | 128 | forward 3 | SP |
| 579 | 238602.2 | 613 | 666 | forward 1 | TM |
| 579 | 238602.2 | 1073 | 1129 | forward 2 | TM |
| 579 | 238602.2 | 1205 | 1261 | forward 2 | TM |
| 579 | 238602.2 | 1082 | 1126 | forward 2 | SP |
| 579 | 238602.2 | 599 | 679 | forward 2 | TM |
| 579 | 238602.2 | 634 | 693 | forward 1 | TM |
| 579 | 238602.2 | 479 | 556 | forward 2 | TM |
| 579 | 238602.2 | 482 | 532 | forward 2 | TM |
| 579 | 238602.2 | 649 | 726 | forward 1 | TM |
| 580 | 363007.1 | 669 | 755 | forward 3 | TM |
| 580 | 363007.1 | 240 | 290 | forward 3 | TM |
| 580 | 363007.1 | 246 | 308 | forward 3 | TM |
| 582 | 3478236CD1 | 1 | 21 | | SP |
| 582 | 3478236CD1 | 1 | 26 | | SP |
| 582 | 3478236CD1 | 1 | 26 | | SP |
| 582 | 3478236CD1 | 191 | 217 | | SP |
| 584 | 2466714CD1 | 328 | 347 | | TM |
| 584 | 2466714CD1 | 281 | 303 | | SP |
| 584 | 2466714CD1 | 70 | 98 | | SP |
| 584 | 2466714CD1 | 322 | 342 | | TM |
| 584 | 2466714CD1 | 78 | 97 | | TM |
| 584 | 2466714CD1 | 330 | 347 | | TM |
| 584 | 2466714CD1 | 200 | 216 | | TM |
| 584 | 2466714CD1 | 330 | 349 | | SP |
| 584 | 2466714CD1 | 357 | 385 | | SP |
| 584 | 2466714CD1 | 433 | 453 | | TM |
| 584 | 2466714CD1 | 365 | 388 | | TM |
| 584 | 2466714CD1 | 197 | 217 | | TM |
| 584 | 2466714CD1 | 169 | 191 | | TM |
| 584 | 2466714CD1 | 70 | 94 | | SP |
| 584 | 2466714CD1 | 47 | 69 | | TM |
| 584 | 2466714CD1 | 70 | 92 | | SP |
| 584 | 2466714CD1 | 68 | 88 | | TM |
| 584 | 2466714CD1 | 433 | 451 | | TM |
| 584 | 2466714CD1 | 371 | 387 | | TM |
| 584 | 2466714CD1 | 70 | 90 | | SP |
| 584 | 2466714CD1 | 366 | 387 | | TM |
| 584 | 2466714CD1 | 197 | 216 | | TM |
| 584 | 2466714CD1 | 432 | 454 | | TM |
| 587 | 246037.28 | 886 | 948 | forward 1 | TM |
| 587 | 246037.28 | 895 | 951 | forward 1 | TM |
| 587 | 246037.28 | 901 | 951 | forward 1 | TM |
| 588 | 337183.1 | 1091 | 1144 | forward 2 | TM |
| 588 | 337183.1 | 215 | 262 | forward 2 | TM |
| 592 | 480968.13 | 3001 | 3057 | forward 1 | TM |
| 592 | 480968.13 | 3187 | 3249 | forward 1 | TM |
| 592 | 480968.13 | 3056 | 3115 | forward 2 | SP |
| 592 | 480968.13 | 1131 | 1190 | forward 3 | SP |
| 592 | 480968.13 | 3809 | 3892 | forward 2 | TM |
| 592 | 480968.13 | 2791 | 2850 | forward 1 | SP |
| 592 | 480968.13 | 1336 | 1392 | forward 1 | SP |
| 592 | 480968.13 | 2791 | 2859 | forward 1 | SP |
| 592 | 480968.13 | 4086 | 4139 | forward 3 | TM |
| 592 | 480968.13 | 2990 | 3046 | forward 2 | TM |
| 592 | 480968.13 | 1333 | 1392 | forward 1 | SP |
| 592 | 480968.13 | 1315 | 1392 | forward 1 | SP |
| 592 | 480968.13 | 1131 | 1205 | forward 3 | SP |
| 592 | 480968.13 | 1321 | 1392 | forward 1 | SP |
| 592 | 480968.13 | 2987 | 3049 | forward 2 | TM |
| 592 | 480968.13 | 1327 | 1392 | forward 1 | SP |
| 595 | 998599.8 | 318 | 389 | forward 3 | TM |
| 595 | 998599.8 | 327 | 383 | forward 3 | SP |
| 595 | 998599.8 | 309 | 368 | forward 3 | TM |
| 595 | 998599.8 | 312 | 365 | forward 3 | TM |
| 598 | 344186.12 | 1508 | 1570 | forward 2 | TM |
| 598 | 344186.12 | 1214 | 1273 | forward 2 | SP |
| 598 | 344186.12 | 1296 | 1352 | forward 3 | TM |
| 598 | 344186.12 | 1217 | 1276 | forward 2 | TM |
| 598 | 344186.12 | 1217 | 1273 | forward 2 | SP |
| 598 | 344186.12 | 1208 | 1273 | forward 2 | SP |
| 603 | 208376.1 | 73 | 129 | forward 1 | TM |
| 608 | 210011.1 | 1246 | 1317 | forward 1 | SP |
| 608 | 210011.1 | 1246 | 1317 | forward 1 | SP |
| 608 | 210011.1 | 1246 | 1332 | forward 1 | SP |
| 609 | 480336.3 | 557 | 610 | forward 2 | SP |
| 610 | 1024610.45 | 701 | 781 | forward 2 | SP |
| 610 | 1024610.45 | 701 | 775 | forward 2 | SP |
| 610 | 1024610.45 | 701 | 760 | forward 2 | TM |
| 613 | 22632.1 | 664 | 711 | forward 1 | TM |
| 626 | 1344185CD1 | 13 | 28 | | SP |
| 626 | 1344185CD1 | 12 | 29 | | TM |
| 626 | 1344185CD1 | 1 | 23 | | SP |
| 626 | 1344185CD1 | 1 | 26 | | SP |
| 626 | 1344185CD1 | 1 | 28 | | SP |
| 629 | 336435.2 | 926 | 979 | forward 2 | TM |
| 629 | 336435.2 | 440 | 511 | forward 2 | TM |
| 629 | 336435.2 | 1460 | 1531 | forward 2 | TM |
| 629 | 336435.2 | 554 | 613 | forward 2 | TM |
| 629 | 336435.2 | 806 | 862 | forward 2 | TM |
| 629 | 336435.2 | 551 | 613 | forward 2 | TM |
| 629 | 336435.2 | 926 | 985 | forward 2 | TM |
| 629 | 336435.2 | 2363 | 2437 | forward 2 | SP |
| 629 | 336435.2 | 458 | 517 | forward 2 | TM |
| 629 | 336435.2 | 1460 | 1516 | forward 2 | TM |
| 629 | 336435.2 | 2363 | 2443 | forward 2 | SP |
| 630 | 231558.1 | 449 | 514 | forward 2 | SP |
| 631 | 247784.3 | 596 | 667 | forward 2 | SP |
| 631 | 247784.3 | 596 | 688 | forward 2 | SP |
| 632 | 238322.6 | 1615 | 1671 | forward 1 | SP |
| 632 | 238322.6 | 1606 | 1671 | forward 1 | SP |
| 632 | 238322.6 | 1597 | 1671 | forward 1 | SP |
| 632 | 238322.6 | 1837 | 1884 | forward 1 | SP |
| 632 | 238322.6 | 1408 | 1467 | forward 1 | SP |
| 632 | 238322.6 | 1908 | 1979 | forward 3 | SP |
| 632 | 238322.6 | 947 | 1024 | forward 2 | SP |
| 632 | 238322.6 | 1822 | 1911 | forward 1 | SP |
| 632 | 238322.6 | 1600 | 1686 | forward 1 | SP |
| 632 | 238322.6 | 1837 | 1911 | forward 1 | SP |
| 632 | 238322.6 | 1837 | 1896 | forward 1 | SP |
| 632 | 238322.6 | 262 | 324 | forward 1 | SP |
| 632 | 238322.6 | 1837 | 1890 | forward 1 | SP |
| 632 | 238322.6 | 274 | 318 | forward 1 | SP |
| 632 | 238322.6 | 1837 | 1902 | forward 1 | SP |
| 632 | 238322.6 | 274 | 327 | forward 1 | SP |
| 632 | 238322.6 | 253 | 324 | forward 1 | SP |
| 632 | 238322.6 | 244 | 324 | forward 1 | SP |
| 632 | 238322.6 | 253 | 324 | forward 1 | SP |
| 634 | 55978.4 | 4343 | 4414 | forward 2 | TM |
| 634 | 55978.4 | 3257 | 3316 | forward 2 | SP |
| 634 | 55978.4 | 2042 | 2101 | forward 2 | SP |
| 636 | 238877.11 | 1777 | 1833 | forward 1 | TM |
| 636 | 238877.11 | 2635 | 2712 | forward 1 | TM |
| 636 | 238877.11 | 2439 | 2495 | forward 3 | TM |
| 636 | 238877.11 | 2788 | 2841 | forward 1 | TM |
| 637 | 238877.8 | 1007 | 1078 | forward 1 | TM |
| 637 | 238877.8 | 1004 | 1060 | forward 2 | TM |
| 637 | 238877.8 | 661 | 738 | forward 1 | TM |
| 637 | 238877.8 | 1019 | 1075 | forward 2 | TM |
| 639 | 997231.16 | 938 | 1009 | forward 2 | TM |
| 640 | 346209.3 | 5004 | 5093 | forward 3 | SP |
| 640 | 346209.3 | 4848 | 4901 | forward 3 | TM |
| 642 | 2515666CD1 | 1 | 19 | | SP |
| 642 | 2515666CD1 | 1 | 30 | | SP |
| 642 | 2515666CD1 | 14 | 32 | | TM |
| 642 | 2515666CD1 | 1 | 22 | | SP |
| 646 | 406830.43 | 758 | 814 | forward 2 | TM |
| 649 | 1045907.4 | 469 | 561 | forward 1 | SP |
| 651 | 85282.1 | 381 | 449 | forward 3 | TM |
| 652 | 86326.1 | 1194 | 1256 | forward 3 | TM |
| 652 | 86326.1 | 645 | 722 | forward 3 | SP |
| 652 | 86326.1 | 1330 | 1389 | forward 1 | TM |
| 652 | 86326.1 | 1225 | 1284 | forward 1 | TM |
| 657 | 95374.1 | 342 | 398 | forward 3 | TM |
| 657 | 95374.1 | 335 | 394 | forward 2 | TM |
| 659 | 33627.28 | 3423 | 3476 | forward 3 | TM |

TABLE 4-continued

| SEQ ID NO | Template ID | Start | Stop | Frame | Hit Type |
|---|---|---|---|---|---|
| 659 | 33627.28 | 2305 | 2400 | forward 1 | SP |
| 659 | 33627.28 | 3090 | 3167 | forward 3 | SP |
| 659 | 33627.28 | 3090 | 3149 | forward 3 | SP |
| 659 | 33627.28 | 2249 | 2332 | forward 2 | SP |
| 659 | 33627.28 | 1180 | 1239 | forward 1 | TM |
| 659 | 33627.28 | 2252 | 2308 | forward 2 | TM |
| 659 | 33627.28 | 1983 | 2033 | forward 3 | TM |
| 659 | 33627.28 | 2273 | 2329 | forward 2 | TM |
| 659 | 33627.28 | 2249 | 2323 | forward 2 | SP |
| 659 | 33627.28 | 2243 | 2311 | forward 2 | SP |
| 660 | 33627.33 | 2638 | 2691 | forward 1 | TM |
| 660 | 33627.33 | 2972 | 3025 | forward 2 | TM |
| 660 | 33627.33 | 2960 | 3016 | forward 2 | TM |
| 660 | 33627.33 | 2951 | 3013 | forward 2 | TM |
| 660 | 33627.33 | 2942 | 3013 | forward 2 | TM |
| 661 | 435361.1 | 1447 | 1503 | forward 1 | TM |
| 661 | 435361.1 | 1847 | 1906 | forward 2 | TM |
| 661 | 435361.1 | 1862 | 1930 | forward 2 | TM |
| 664 | 2636759CD1 | 150 | 174 |  | SP |
| 665 | 1083665.4 | 353 | 409 | forward 2 | TM |
| 665 | 1083665.4 | 2 | 52 | forward 2 | TM |
| 665 | 1083665.4 | 9 | 89 | forward 3 | TM |
| 667 | 240518.42 | 540 | 599 | forward 3 | TM |
| 667 | 240518.42 | 1678 | 1788 | forward 1 | SP |
| 667 | 240518.42 | 1741 | 1788 | forward 1 | SP |
| 668 | 1322.4 | 3555 | 3608 | forward 3 | TM |
| 668 | 1322.4 | 3495 | 3548 | forward 3 | TM |
| 668 | 1322.4 | 3496 | 3552 | forward 1 | TM |
| 668 | 1322.4 | 3647 | 3718 | forward 2 | SP |
| 668 | 1322.4 | 3454 | 3528 | forward 1 | TM |
| 668 | 1322.4 | 3475 | 3528 | forward 1 | TM |
| 668 | 1322.4 | 3030 | 3089 | forward 3 | TM |
| 668 | 1322.4 | 3641 | 3733 | forward 2 | TM |
| 668 | 1322.4 | 3647 | 3706 | forward 2 | SP |
| 668 | 1322.4 | 2627 | 2704 | forward 2 | TM |
| 668 | 1322.4 | 3534 | 3608 | forward 3 | TM |
| 669 | 208282.1 | 642 | 704 | forward 3 | TM |
| 669 | 208282.1 | 705 | 758 | forward 3 | TM |
| 669 | 208282.1 | 1072 | 1128 | forward 1 | TM |
| 671 | 345272.2 | 707 | 781 | forward 2 | SP |
| 674 | 13937.3 | 1988 | 2041 | forward 2 | TM |
| 674 | 13937.3 | 257 | 328 | forward 2 | SP |
| 674 | 13937.3 | 263 | 352 | forward 2 | SP |
| 674 | 13937.3 | 263 | 328 | forward 2 | SP |
| 679 | 1325741.2 | 804 | 866 | forward 3 | SP |
| 679 | 1325741.2 | 1463 | 1537 | forward 2 | SP |
| 679 | 1325741.2 | 804 | 860 | forward 3 | SP |
| 682 | 118836.2 | 5963 | 6019 | forward 2 | TM |
| 682 | 118836.2 | 3927 | 4010 | forward 3 | TM |
| 682 | 118836.2 | 5969 | 6019 | forward 2 | TM |
| 682 | 118836.2 | 2930 | 3019 | forward 2 | SP |
| 682 | 118836.2 | 4483 | 4575 | forward 1 | SP |
| 682 | 118836.2 | 3957 | 4016 | forward 3 | SP |
| 682 | 118836.2 | 1107 | 1160 | forward 3 | TM |
| 683 | 3303.2 | 1741 | 1803 | forward 1 | TM |
| 683 | 3303.2 | 1853 | 1903 | forward 2 | TM |
| 683 | 3303.2 | 6808 | 6858 | forward 1 | TM |
| 683 | 3303.2 | 2326 | 2388 | forward 1 | TM |
| 683 | 3303.2 | 2748 | 2804 | forward 3 | TM |
| 683 | 3303.2 | 6646 | 6696 | forward 1 | TM |
| 683 | 3303.2 | 3786 | 3857 | forward 3 | TM |
| 683 | 3303.2 | 3777 | 3854 | forward 3 | TM |
| 683 | 3303.2 | 6814 | 6870 | forward 1 | TM |
| 683 | 3303.2 | 3779 | 3835 | forward 3 | TM |
| 683 | 3303.2 | 2571 | 2627 | forward 3 | TM |
| 683 | 3303.2 | 6790 | 6852 | forward 1 | TM |
| 683 | 3303.2 | 6784 | 6846 | forward 1 | SP |
| 683 | 3303.2 | 3780 | 3836 | forward 3 | SP |
| 683 | 3303.2 | 3780 | 3845 | forward 3 | SP |
| 683 | 3303.2 | 2751 | 2804 | forward 3 | TM |
| 683 | 3303.2 | 5390 | 5452 | forward 2 | TM |
| 683 | 3303.2 | 5408 | 5473 | forward 2 | TM |
| 683 | 3303.2 | 868 | 957 | forward 1 | SP |
| 683 | 3303.2 | 2745 | 2807 | forward 3 | TM |
| 683 | 3303.2 | 3780 | 3824 | forward 3 | SP |
| 683 | 3303.2 | 5405 | 5461 | forward 2 | TM |
| 683 | 3303.2 | 5396 | 5470 | forward 2 | TM |
| 683 | 3303.2 | 5405 | 5461 | forward 2 | TM |
| 686 | 1383062.7 | 165 | 245 | forward 3 | SP |
| 687 | 1383062.8 | 139 | 219 | forward 1 | SP |
| 688 | 1383794.1 | 154 | 225 | forward 1 | SP |
| 688 | 1383794.1 | 154 | 240 | forward 1 | SP |
| 689 | 406289.1 | 521 | 577 | forward 2 | TM |
| 690 | 175918.15 | 1678 | 1722 | forward 1 | SP |
| 690 | 175918.15 | 2620 | 2697 | forward 1 | SP |
| 690 | 175918.15 | 5448 | 5504 | forward 3 | TM |
| 690 | 175918.15 | 5772 | 5837 | forward 3 | TM |
| 690 | 175918.15 | 5665 | 5718 | forward 1 | TM |
| 690 | 175918.15 | 5186 | 5242 | forward 2 | TM |
| 690 | 175918.15 | 5787 | 5849 | forward 3 | TM |
| 690 | 175918.15 | 5656 | 5727 | forward 1 | TM |
| 690 | 175918.15 | 5784 | 5837 | forward 3 | TM |
| 690 | 175918.15 | 1678 | 1734 | forward 1 | SP |
| 690 | 175918.15 | 5751 | 5822 | forward 3 | TM |
| 690 | 175918.15 | 5772 | 5828 | forward 3 | TM |
| 691 | 1068290.1 | 2534 | 2596 | forward 2 | SP |
| 692 | 94873.1 | 191 | 253 | forward 2 | SP |
| 693 | 403616.1 | 193 | 261 | forward 1 | SP |
| 693 | 403616.1 | 190 | 243 | forward 1 | TM |
| 693 | 403616.1 | 178 | 240 | forward 1 | TM |
| 693 | 403616.1 | 175 | 237 | forward 1 | TM |
| 694 | 95088.1 | 448 | 516 | forward 1 | TM |
| 694 | 95088.1 | 369 | 419 | forward 3 | TM |
| 694 | 95088.1 | 387 | 464 | forward 3 | TM |
| 694 | 95088.1 | 369 | 425 | forward 3 | TM |
| 695 | 230402.1 | 314 | 376 | forward 2 | TM |
| 696 | 95172.1 | 591 | 644 | forward 3 | TM |
| 696 | 95172.1 | 220 | 282 | forward 1 | TM |
| 700 | 335375.3 | 815 | 868 | forward 2 | TM |
| 700 | 335375.3 | 545 | 607 | forward 2 | SP |
| 700 | 335375.3 | 224 | 271 | forward 2 | SP |
| 702 | 229514.1 | 153 | 209 | forward 3 | TM |
| 702 | 229514.1 | 173 | 229 | forward 3 | TM |
| 702 | 229514.1 | 1219 | 1287 | forward 1 | SP |
| 702 | 229514.1 | 182 | 232 | forward 1 | TM |
| 702 | 229514.1 | 1219 | 1272 | forward 1 | SP |
| 702 | 229514.1 | 1228 | 1287 | forward 1 | TM |
| 703 | 95573.1 | 154 | 210 | forward 1 | TM |
| 704 | 230463.1 | 65 | 127 | forward 2 | TM |
| 704 | 230463.1 | 47 | 118 | forward 2 | TM |
| 704 | 230463.1 | 89 | 145 | forward 2 | TM |
| 704 | 230463.1 | 1134 | 1196 | forward 3 | TM |
| 706 | 218090.9 | 368 | 433 | forward 2 | SP |
| 706 | 218090.9 | 1025 | 1087 | forward 2 | SP |
| 714 | 208748.4 | 845 | 904 | forward 2 | TM |
| 715 | 407517.2 | 5120 | 5206 | forward 2 | TM |
| 715 | 407517.2 | 5378 | 5446 | forward 2 | SP |
| 715 | 407517.2 | 2353 | 2442 | forward 1 | SP |
| 715 | 407517.2 | 1007 | 1057 | forward 2 | TM |
| 715 | 407517.2 | 1153 | 1215 | forward 1 | SP |
| 716 | 233997.1 | 3468 | 3536 | forward 3 | TM |
| 716 | 233997.1 | 2169 | 2228 | forward 3 | SP |
| 716 | 233997.1 | 2791 | 2856 | forward 3 | SP |
| 716 | 233997.1 | 2791 | 2868 | forward 3 | SP |
| 716 | 233997.1 | 2791 | 2877 | forward 1 | SP |
| 718 | 330862.6 | 209 | 292 | forward 2 | TM |
| 718 | 330862.6 | 68 | 136 | forward 2 | SP |
| 718 | 330862.6 | 68 | 127 | forward 2 | SP |
| 718 | 330862.6 | 70 | 141 | forward 1 | TM |
| 719 | 330862.8 | 1275 | 1328 | forward 3 | TM |
| 719 | 330862.8 | 984 | 1058 | forward 3 | SP |
| 719 | 330862.8 | 984 | 1058 | forward 3 | SP |
| 722 | 1098722.6 | 1625 | 1702 | forward 2 | TM |
| 722 | 1098722.6 | 1534 | 1587 | forward 1 | SP |
| 722 | 1098722.6 | 1534 | 1599 | forward 1 | SP |
| 722 | 1098722.6 | 381 | 464 | forward 3 | TM |
| 722 | 1098722.6 | 1534 | 1599 | forward 1 | SP |
| 724 | 201395.4 | 3659 | 3757 | forward 2 | SP |
| 724 | 201395.4 | 586 | 657 | forward 1 | SP |
| 724 | 201395.4 | 2381 | 2440 | forward 2 | SP |
| 724 | 201395.4 | 3718 | 3783 | forward 3 | SP |
| 724 | 201395.4 | 3667 | 3774 | forward 1 | SP |
| 724 | 201395.4 | 3694 | 3762 | forward 1 | TM |
| 724 | 201395.4 | 4462 | 4509 | forward 1 | SP |

TABLE 4-continued

| SEQ ID NO | Template ID | Start | Stop | Frame | Hit Type |
|---|---|---|---|---|---|
| 724 | 201395.4 | 3700 | 3768 | forward 1 | TM |
| 724 | 201395.4 | 3718 | 3765 | forward 1 | TM |
| 724 | 201395.4 | 2339 | 2452 | forward 2 | SP |
| 724 | 201395.4 | 2381 | 2452 | forward 2 | SP |
| 724 | 201395.4 | 3703 | 3765 | forward 1 | TM |
| 724 | 201395.4 | 3703 | 3759 | forward 1 | TM |
| 728 | 983684.1 | 214 | 300 | forward 1 | TM |
| 729 | 983684.2 | 422 | 481 | forward 2 | TM |
| 734 | 199290.9 | 6174 | 6224 | forward 3 | TM |
| 734 | 199290.9 | 4201 | 4260 | forward 1 | TM |
| 734 | 199290.9 | 4999 | 5055 | forward 1 | TM |
| 734 | 199290.9 | 6159 | 6227 | forward 3 | SP |
| 734 | 199290.9 | 3961 | 4029 | forward 1 | SP |
| 734 | 199290.9 | 3988 | 4050 | forward 1 | TM |
| 734 | 199290.9 | 6591 | 6671 | forward 3 | TM |
| 734 | 199290.9 | 3588 | 3653 | forward 3 | SP |
| 734 | 199290.9 | 5689 | 5754 | forward 1 | SP |
| 734 | 199290.9 | 3988 | 4047 | forward 1 | TM |
| 734 | 199290.9 | 5051 | 5107 | forward 2 | TM |
| 734 | 199290.9 | 6174 | 6230 | forward 3 | TM |
| 734 | 199290.9 | 4198 | 4254 | forward 1 | SP |
| 734 | 199290.9 | 3961 | 4023 | forward 1 | SP |
| 734 | 199290.9 | 6588 | 6647 | forward 3 | TM |
| 734 | 199290.9 | 6603 | 6647 | forward 3 | SP |
| 734 | 199290.9 | 5665 | 5721 | forward 1 | TM |
| 734 | 199290.9 | 5225 | 5275 | forward 2 | TM |
| 734 | 199290.9 | 6585 | 6632 | forward 3 | TM |
| 734 | 199290.9 | 4996 | 5058 | forward 1 | TM |
| 734 | 199290.9 | 2115 | 2171 | forward 3 | SP |
| 734 | 199290.9 | 4189 | 4260 | forward 1 | TM |
| 734 | 199290.9 | 2115 | 2165 | forward 3 | SP |
| 734 | 199290.9 | 4996 | 5052 | forward 1 | TM |
| 734 | 199290.9 | 6159 | 6242 | forward 3 | SP |
| 734 | 199290.9 | 6159 | 6233 | forward 3 | SP |
| 734 | 199290.9 | 2103 | 2153 | forward 3 | TM |
| 734 | 199290.9 | 6159 | 6221 | forward 3 | SP |
| 739 | 208379.1 | 2649 | 2711 | forward 3 | TM |
| 739 | 208379.1 | 2637 | 2711 | forward 3 | TM |
| 739 | 208379.1 | 2135 | 2191 | forward 2 | SP |
| 739 | 208379.1 | 2674 | 2733 | forward 1 | TM |
| 739 | 208379.1 | 2070 | 2129 | forward 3 | TM |
| 740 | 251631.6 | 230 | 298 | forward 2 | TM |
| 742 | 2847188CD1 | 1 | 26 |  | SP |
| 742 | 2847188CD1 | 1 | 22 |  | SP |
| 742 | 2847188CD1 | 1 | 25 |  | SP |
| 743 | 100579.1 | 28 | 81 | forward 1 | TM |
| 744 | 1327498.1 | 32 | 85 | forward 2 | SP |
| 745 | 1330212.14 | 532 | 588 | forward 1 | TM |
| 747 | 252471.4 | 1129 | 1182 | forward 1 | TM |
| 750 | 1330122.1 | 24310 | 24369 | forward 1 | TM |
| 750 | 1330122.1 | 22842 | 22904 | forward 3 | TM |
| 750 | 1330122.1 | 13584 | 13646 | forward 3 | SP |
| 750 | 1330122.1 | 16815 | 16868 | forward 3 | TM |
| 750 | 1330122.1 | 10236 | 10295 | forward 3 | TM |
| 750 | 1330122.1 | 19685 | 19768 | forward 2 | TM |
| 750 | 1330122.1 | 15520 | 15579 | forward 1 | SP |
| 750 | 1330122.1 | 9440 | 9526 | forward 2 | TM |
| 750 | 1330122.1 | 11175 | 11228 | forward 3 | TM |
| 750 | 1330122.1 | 14682 | 14738 | forward 3 | TM |
| 750 | 1330122.1 | 10273 | 10344 | forward 1 | TM |
| 750 | 1330122.1 | 15657 | 15740 | forward 3 | SP |
| 750 | 1330122.1 | 23238 | 23306 | forward 3 | SP |
| 750 | 1330122.1 | 17349 | 17402 | forward 3 | TM |
| 750 | 1330122.1 | 24203 | 24259 | forward 2 | TM |
| 750 | 1330122.1 | 14151 | 14210 | forward 3 | TM |
| 750 | 1330122.1 | 10221 | 10289 | forward 3 | TM |
| 750 | 1330122.1 | 15189 | 15266 | forward 3 | SP |
| 750 | 1330122.1 | 2488 | 2538 | forward 1 | SP |
| 750 | 1330122.1 | 13004 | 13060 | forward 2 | SP |
| 750 | 1330122.1 | 18699 | 18758 | forward 3 | TM |
| 750 | 1330122.1 | 3822 | 3899 | forward 3 | TM |
| 750 | 1330122.1 | 2503 | 2565 | forward 1 | TM |
| 750 | 1330122.1 | 16212 | 16265 | forward 3 | TM |
| 750 | 1330122.1 | 18862 | 18942 | forward 1 | TM |
| 750 | 1330122.1 | 20473 | 20535 | forward 1 | TM |
| 750 | 1330122.1 | 24050 | 24112 | forward 2 | SP |
| 750 | 1330122.1 | 2518 | 2595 | forward 1 | TM |
| 750 | 1330122.1 | 23387 | 23461 | forward 2 | SP |
| 750 | 1330122.1 | 3687 | 3743 | forward 3 | TM |
| 750 | 1330122.1 | 15012 | 15089 | forward 3 | TM |
| 750 | 1330122.1 | 24197 | 24244 | forward 2 | TM |
| 750 | 1330122.1 | 15654 | 15710 | forward 3 | TM |
| 750 | 1330122.1 | 12709 | 12765 | forward 1 | TM |
| 750 | 1330122.1 | 5349 | 5417 | forward 3 | TM |
| 750 | 1330122.1 | 7305 | 7358 | forward 3 | SP |
| 750 | 1330122.1 | 23050 | 23130 | forward 1 | TM |
| 750 | 1330122.1 | 16220 | 16282 | forward 2 | TM |
| 750 | 1330122.1 | 21438 | 21485 | forward 3 | TM |
| 750 | 1330122.1 | 15189 | 15245 | forward 3 | SP |
| 750 | 1330122.1 | 24313 | 24366 | forward 1 | TM |
| 750 | 1330122.1 | 14619 | 14705 | forward 3 | TM |
| 750 | 1330122.1 | 7403 | 7462 | forward 2 | TM |
| 750 | 1330122.1 | 344 | 394 | forward 2 | TM |
| 750 | 1330122.1 | 10270 | 10326 | forward 1 | TM |
| 750 | 1330122.1 | 24050 | 24121 | forward 2 | SP |
| 750 | 1330122.1 | 15345 | 15395 | forward 3 | SP |
| 750 | 1330122.1 | 24213 | 24272 | forward 3 | TM |
| 750 | 1330122.1 | 2488 | 2547 | forward 1 | SP |
| 750 | 1330122.1 | 14607 | 14663 | forward 3 | TM |
| 750 | 1330122.1 | 13004 | 13066 | forward 2 | SP |
| 750 | 1330122.1 | 14604 | 14672 | forward 3 | TM |
| 750 | 1330122.1 | 9895 | 9945 | forward 1 | TM |
| 750 | 1330122.1 | 17343 | 17399 | forward 3 | TM |
| 750 | 1330122.1 | 8867 | 8932 | forward 2 | SP |
| 750 | 1330122.1 | 15345 | 15413 | forward 3 | TM |
| 750 | 1330122.1 | 5030 | 5092 | forward 2 | TM |
| 750 | 1330122.1 | 2509 | 2574 | forward 1 | TM |
| 750 | 1330122.1 | 15360 | 15419 | forward 3 | TM |
| 750 | 1330122.1 | 16215 | 16271 | forward 3 | TM |
| 750 | 1330122.1 | 5364 | 5417 | forward 3 | TM |
| 750 | 1330122.1 | 13075 |  | forward 2 | SP |
| 750 | 1330122.1 | 21435 | 21494 | forward 3 | TM |
| 750 | 1330122.1 | 21049 | 21099 | forward 1 | TM |
| 750 | 1330122.1 | 3645 | 3719 | forward 3 | TM |
| 750 | 1330122.1 | 18589 | 18651 | forward 1 | TM |
| 750 | 1330122.1 | 7305 | 7373 | forward 3 | SP |
| 750 | 1330122.1 | 2488 | 2544 | forward 1 | SP |
| 750 | 1330122.1 | 846 | 899 | forward 3 | SP |
| 750 | 1330122.1 | 15654 | 15716 | forward 3 | TM |
| 750 | 1330122.1 | 10239 | 10292 | forward 3 | TM |
| 750 | 1330122.1 | 2488 | 2559 | forward 1 | SP |
| 750 | 1330122.1 | 14688 | 14744 | forward 3 | TM |
| 750 | 1330122.1 | 2500 | 2556 | forward 1 | TM |
| 750 | 1330122.1 | 13004 | 13069 | forward 2 | SP |
| 750 | 1330122.1 | 14610 | 14672 | forward 3 | TM |
| 750 | 1330122.1 | 7393 | 7455 | forward 3 | TM |
| 750 | 1330122.1 | 20476 | 20532 | forward 1 | TM |
| 750 | 1330122.1 | 2488 | 2556 | forward 1 | SP |
| 751 | 407468.1 | 484 | 546 | forward 1 | TM |
| 751 | 407468.1 | 481 | 552 | forward 1 | TM |
| 752 | 1330149.46 | 632 | 682 | forward 2 | TM |
| 752 | 1330149.46 | 1117 | 1167 | forward 1 | TM |
| 752 | 1330149.46 | 4076 | 4144 | forward 2 | TM |
| 752 | 1330149.46 | 1698 | 1769 | forward 3 | TM |
| 752 | 1330149.46 | 2484 | 2564 | forward 3 | SP |
| 752 | 1330149.46 | 2363 | 2461 | forward 2 | SP |
| 752 | 1330149.46 | 1105 | 1164 | forward 1 | TM |
| 752 | 1330149.46 | 4088 | 4150 | forward 3 | TM |
| 752 | 1330149.46 | 4088 | 4144 | forward 2 | TM |
| 753 | 32476.2 | 123 | 188 | forward 3 | SP |
| 753 | 32476.2 | 123 | 185 | forward 3 | SP |
| 753 | 32476.2 | 144 | 203 | forward 3 | TM |
| 757 | 1719478CD1 | 1298 | 1318 |  | TM |
| 757 | 1719478CD1 | 1214 | 1237 |  | TM |
| 757 | 1719478CD1 | 1734 | 1760 |  | TM |
| 757 | 1719478CD1 | 1305 | 1328 |  | SP |
| 757 | 1719478CD1 | 249 | 266 |  | SP |
| 757 | 1719478CD1 | 1535 | 1552 |  | TM |
| 757 | 1719478CD1 | 383 | 403 |  | TM |
| 757 | 1719478CD1 | 932 | 949 |  | TM |
| 757 | 1719478CD1 | 843 | 868 |  | TM |
| 757 | 1719478CD1 | 767 | 786 |  | TM |
| 757 | 1719478CD1 | 1423 | 1446 |  | TM |
| 757 | 1719478CD1 | 1633 | 1650 |  | TM |

TABLE 4-continued

| SEQ ID NO | Template ID | Start | Stop | Frame | Hit Type |
|---|---|---|---|---|---|
| 757 | 1719478CD1 | 1425 | 1445 | | TM |
| 757 | 1719478CD1 | 941 | 958 | | SP |
| 757 | 1719478CD1 | 1311 | 1333 | | SP |
| 757 | 1719478CD1 | 1248 | 1264 | | TM |
| 757 | 1719478CD1 | 1567 | 1585 | | TM |
| 757 | 1719478CD1 | 1424 | 1441 | | TM |
| 757 | 1719478CD1 | 939 | 961 | | TM |
| 757 | 1719478CD1 | 187 | 204 | | TM |
| 757 | 1719478CD1 | 855 | 872 | | TM |
| 757 | 1719478CD1 | 1311 | 1331 | | SP |
| 757 | 1719478CD1 | 1621 | 1644 | | TM |
| 757 | 1719478CD1 | 1631 | 1656 | | TM |
| 757 | 1719478CD1 | 938 | 958 | | SP |
| 757 | 1719478CD1 | 939 | 961 | | SP |
| 757 | 1719478CD1 | 1182 | 1199 | | TM |
| 757 | 1719478CD1 | 1627 | 1653 | | SP |
| 757 | 1719478CD1 | 249 | 269 | | SP |
| 757 | 1719478CD1 | 850 | 870 | | TM |
| 757 | 1719478CD1 | 1307 | 1324 | | TM |
| 757 | 1719478CD1 | 1628 | 1648 | | SP |
| 757 | 1719478CD1 | 843 | 865 | | TM |
| 757 | 1719478CD1 | 1727 | 1745 | | TM |
| 757 | 1719478CD1 | 1636 | 1658 | | TM |
| 757 | 1719478CD1 | 1311 | 1328 | | SP |
| 757 | 1719478CD1 | 379 | 394 | | TM |
| 757 | 1719478CD1 | 1562 | 1582 | | TM |
| 757 | 1719478CD1 | 936 | 956 | | TM |
| 757 | 1719478CD1 | 1539 | 1557 | | TM |
| 757 | 1719478CD1 | 932 | 952 | | TM |
| 757 | 1719478CD1 | 1627 | 1648 | | SP |
| 757 | 1719478CD1 | 1313 | 1332 | | TM |
| 757 | 1719478CD1 | 1427 | 1446 | | TM |
| 757 | 1719478CD1 | 939 | 960 | | TM |
| 757 | 1719478CD1 | 211 | 228 | | TM |
| 757 | 1719478CD1 | 939 | 962 | | SP |
| 757 | 1719478CD1 | 1562 | 1584 | | TM |
| 757 | 1719478CD1 | 1566 | 1583 | | TM |
| 757 | 1719478CD1 | 384 | 405 | | TM |
| 757 | 1719478CD1 | 939 | 967 | | SP |
| 757 | 1719478CD1 | 380 | 407 | | TM |
| 757 | 1719478CD1 | 379 | 398 | | TM |
| 757 | 1719478CD1 | 1725 | 1748 | | TM |
| 757 | 1719478CD1 | 1627 | 1651 | | SP |
| 757 | 1719478CD1 | 248 | 266 | | TM |
| 757 | 1719478CD1 | 1636 | 1655 | | TM |
| 757 | 1719478CD1 | 858 | 876 | | TM |
| 757 | 1719478CD1 | 1422 | 1445 | | TM |
| 757 | 1719478CD1 | 378 | 401 | | TM |
| 759 | 236749.1 | 197 | 265 | forward 2 | SP |
| 759 | 236749.1 | 1415 | 1471 | forward 2 | TM |
| 759 | 236749.1 | 1531 | 1587 | forward 1 | TM |
| 759 | 236749.1 | 224 | 283 | forward 2 | TM |
| 759 | 236749.1 | 218 | 265 | forward 2 | SP |
| 759 | 236749.1 | 1492 | 1548 | forward 1 | SP |
| 759 | 236749.1 | 197 | 271 | forward 2 | SP |
| 759 | 236749.1 | 221 | 286 | forward 2 | TM |
| 759 | 236749.1 | 1269 | 1352 | forward 3 | TM |
| 759 | 236749.1 | 221 | 280 | forward 2 | TM |
| 759 | 236749.1 | 197 | 289 | forward 2 | SP |
| 760 | 407124.2 | 1245 | 1307 | forward 3 | TM |
| 760 | 407124.2 | 1272 | 1325 | forward 3 | TM |
| 760 | 407124.2 | 1245 | 1304 | forward 3 | TM |
| 760 | 407124.2 | 1257 | 1328 | forward 3 | TM |
| 760 | 407124.2 | 1111 | 1185 | forward 1 | TM |
| 762 | 400253.14 | 1107 | 1160 | forward 3 | SP |
| 762 | 400253.14 | 1089 | 1163 | forward 3 | SP |
| 762 | 400253.14 | 1104 | 1166 | forward 3 | SP |
| 762 | 400253.14 | 1110 | 1172 | forward 3 | TM |
| 762 | 400253.14 | 1086 | 1166 | forward 3 | SP |
| 762 | 400253.14 | 1101 | 1166 | forward 3 | SP |
| 762 | 400253.14 | 222 | 287 | forward 3 | SP |
| 762 | 400253.14 | 1116 | 1178 | forward 3 | TM |
| 762 | 400253.14 | 222 | 302 | forward 3 | SP |
| 762 | 400253.14 | 1110 | 1172 | forward 3 | TM |
| 762 | 400253.14 | 222 | 293 | forward 3 | SP |
| 762 | 400253.14 | 222 | 284 | forward 3 | SP |
| 764 | 978065.5 | 912 | 971 | forward 3 | TM |
| 766 | 984236.4 | 912 | 968 | forward 3 | SP |
| 766 | 984236.4 | 1037 | 1093 | forward 2 | TM |
| 766 | 984236.4 | 1415 | 1477 | forward 2 | TM |
| 766 | 984236.4 | 391 | 480 | forward 1 | SP |
| 766 | 984236.4 | 996 | 1079 | forward 3 | SP |
| 766 | 984236.4 | 1037 | 1090 | forward 2 | TM |
| 770 | 7808.1 | 1295 | 1357 | forward 2 | SP |
| 770 | 7808.1 | 1310 | 1360 | forward 2 | TM |
| 770 | 7808.1 | 1295 | 1348 | forward 2 | SP |
| 770 | 7808.1 | 1262 | 1336 | forward 2 | TM |
| 770 | 7808.1 | 2888 | 2953 | forward 2 | TM |
| 770 | 7808.1 | 3155 | 3217 | forward 2 | TM |
| 770 | 7808.1 | 3050 | 3106 | forward 2 | TM |
| 770 | 7808.1 | 3050 | 3109 | forward 2 | SP |
| 770 | 7808.1 | 1295 | 1372 | forward 2 | SP |
| 770 | 7808.1 | 3152 | 3205 | forward 2 | TM |
| 770 | 7808.1 | 3050 | 3103 | forward 2 | SP |
| 770 | 7808.1 | 3050 | 3118 | forward 2 | SP |
| 771 | 403627.38 | 140 | 196 | forward 2 | TM |
| 771 | 403627.38 | 120 | 197 | forward 3 | SP |
| 771 | 403627.38 | 560 | 619 | forward 2 | TM |
| 771 | 403627.38 | 638 | 706 | forward 2 | SP |
| 771 | 403627.38 | 747 | 833 | forward 3 | SP |
| 771 | 403627.38 | 766 | 819 | forward 1 | SP |
| 771 | 403627.38 | 954 | 1022 | forward 3 | TM |
| 771 | 403627.38 | 128 | 187 | forward 2 | SP |
| 771 | 403627.38 | 638 | 697 | forward 2 | SP |
| 773 | 474622.1 | 3087 | 3134 | forward 3 | TM |
| 773 | 474622.1 | 610 | 681 | forward 1 | TM |
| 773 | 474622.1 | 1939 | 1998 | forward 1 | TM |
| 773 | 474622.1 | 613 | 675 | forward 1 | TM |
| 773 | 474622.1 | 2424 | 2489 | forward 3 | TM |
| 773 | 474622.1 | 1838 | 1900 | forward 2 | TM |
| 773 | 474622.1 | 604 | 657 | forward 1 | TM |
| 773 | 474622.1 | 1941 | 2000 | forward 3 | TM |
| 773 | 474622.1 | 1829 | 1903 | forward 2 | TM |
| 773 | 474622.1 | 601 | 678 | forward 1 | TM |
| 773 | 474622.1 | 1917 | 1982 | forward 3 | SP |
| 775 | 1383009.67 | 10 | 96 | forward 1 | SP |
| 779 | 1384716.4 | 798 | 845 | forward 3 | SP |
| 779 | 1384716.4 | 445 | 531 | forward 1 | SP |
| 783 | 256138.1 | 312 | 368 | forward 3 | TM |
| 783 | 256138.1 | 289 | 342 | forward 1 | TM |
| 784 | 413348.4 | 99 | 173 | forward 3 | SP |
| 784 | 413348.4 | 2300 | 2374 | forward 2 | SP |
| 784 | 413348.4 | 811 | 864 | forward 1 | SP |
| 784 | 413348.4 | 526 | 585 | forward 1 | SP |
| 784 | 413348.4 | 511 | 570 | forward 1 | TM |
| 784 | 413348.4 | 1742 | 1825 | forward 2 | TM |
| 784 | 413348.4 | 1625 | 1678 | forward 2 | TM |
| 784 | 413348.4 | 1475 | 1534 | forward 2 | TM |
| 784 | 413348.4 | 111 | 179 | forward 3 | SP |
| 784 | 413348.4 | 117 | 164 | forward 3 | SP |
| 784 | 413348.4 | 1615 | 1668 | forward 1 | TM |
| 784 | 413348.4 | 814 | 879 | forward 1 | SP |
| 784 | 413348.4 | 511 | 585 | forward 1 | SP |
| 784 | 413348.4 | 814 | 861 | forward 1 | SP |
| 784 | 413348.4 | 117 | 179 | forward 3 | SP |
| 784 | 413348.4 | 117 | 173 | forward 3 | SP |
| 785 | 332088.2 | 49 | 108 | forward 1 | TM |
| 787 | 035282CD1 | 219 | 248 | | SP |
| 788 | 350667.7 | 543 | 632 | forward 3 | SP |
| 788 | 350667.7 | 713 | 802 | forward 2 | SP |
| 790 | 211622.1 | 59 | 121 | forward 2 | TM |
| 790 | 211622.1 | 235 | 288 | forward 1 | TM |
| 790 | 211622.1 | 208 | 276 | forward 1 | TM |
| 790 | 211622.1 | 199 | 285 | forward 1 | TM |
| 790 | 211622.1 | 581 | 637 | forward 2 | TM |
| 790 | 211622.1 | 11 | 58 | forward 2 | TM |
| 790 | 211622.1 | 563 | 625 | forward 2 | TM |
| 790 | 211622.1 | 581 | 658 | forward 2 | TM |
| 790 | 211622.1 | 581 | 631 | forward 2 | TM |
| 791 | 110049.1 | 158 | 217 | forward 2 | SP |
| 791 | 110049.1 | 143 | 214 | forward 2 | SP |
| 797 | 405689.1 | 171 | 218 | forward 3 | SP |
| 797 | 405689.1 | 5 | 76 | forward 2 | SP |
| 797 | 405689.1 | 174 | 227 | forward 3 | SP |

TABLE 4-continued

| SEQ ID NO | Template ID | Start | Stop | Frame | Hit Type |
|---|---|---|---|---|---|
| 797 | 405689.1 | 171 | 230 | forward 3 | SP |
| 797 | 405689.1 | 153 | 227 | forward 3 | SP |
| 797 | 405689.1 | 144 | 227 | forward 3 | SP |
| 797 | 405689.1 | 162 | 227 | forward 3 | SP |
| 798 | 110815.1 | 120 | 197 | forward 3 | TM |
| 799 | 1385527.4 | 3910 | 3969 | forward 1 | TM |
| 799 | 1385527.4 | 3115 | 3174 | forward 1 | SP |
| 799 | 1385527.4 | 1890 | 1982 | forward 3 | SP |
| 799 | 1385527.4 | 3115 | 3171 | forward 1 | SP |
| 799 | 1385527.4 | 1795 | 1887 | forward 1 | SP |
| 799 | 1385527.4 | 3115 | 3189 | forward 1 | SP |
| 799 | 1385527.4 | 2119 | 2220 | forward 1 | SP |
| 799 | 1385527.4 | 3929 | 3985 | forward 1 | TM |
| 801 | 1100724.1 | 501 | 569 | forward 3 | SP |
| 804 | 344017.6 | 1628 | 1681 | forward 2 | TM |
| 804 | 344017.6 | 275 | 319 | forward 2 | SP |
| 804 | 344017.6 | 707 | 772 | forward 2 | SP |
| 804 | 344017.6 | 506 | 565 | forward 2 | SP |
| 805 | 344017.3 | 556 | 618 | forward 1 | TM |
| 805 | 344017.3 | 872 | 928 | forward 2 | TM |
| 805 | 344017.3 | 1414 | 1491 | forward 1 | TM |
| 805 | 344017.3 | 743 | 787 | forward 2 | TM |
| 805 | 344017.3 | 765 | 821 | forward 3 | TM |
| 805 | 344017.3 | 743 | 802 | forward 2 | TM |
| 805 | 344017.3 | 1417 | 1491 | forward 1 | TM |
| 807 | 2770104CD1 | 277 | 297 | | TM |
| 807 | 2770104CD1 | 280 | 301 | | SP |
| 807 | 2770104CD1 | 280 | 300 | | SP |
| 807 | 2770104CD1 | 45 | 60 | | SP |
| 807 | 2770104CD1 | 275 | 295 | | TM |
| 808 | 349204.1 | 595 | 684 | forward 1 | SP |
| 811 | 211881.1 | 651 | 731 | forward 3 | TM |
| 811 | 211881.1 | 663 | 719 | forward 3 | TM |
| 812 | 334749.1 | 307 | 366 | forward 1 | TM |
| 812 | 334749.1 | 307 | 360 | forward 1 | TM |
| 812 | 334749.1 | 288 | 359 | forward 3 | TM |
| 815 | 170915CD1 | 1 | 18 | | SP |
| 815 | 170915CD1 | 1 | 16 | | SP |
| 818 | 2454013CD1 | 245 | 265 | | TM |
| 818 | 2454013CD1 | 251 | 266 | | SP |
| 818 | 2454013CD1 | 234 | 254 | | TM |
| 818 | 2454013CD1 | 1 | 27 | | SP |
| 819 | 427967.6 | 529 | 600 | forward 1 | TM |
| 819 | 427967.6 | 431 | 502 | forward 2 | TM |
| 819 | 427967.6 | 417 | 476 | forward 3 | SP |
| 819 | 427967.6 | 516 | 596 | forward 3 | TM |
| 819 | 427967.6 | 428 | 478 | forward 2 | TM |
| 820 | 427967.4 | 3838 | 3900 | forward 1 | TM |
| 820 | 427967.4 | 2755 | 2820 | forward 1 | TM |
| 820 | 427967.4 | 2776 | 2844 | forward 1 | SP |
| 820 | 427967.4 | 2395 | 2478 | forward 1 | TM |
| 821 | 257016.1 | 153 | 209 | forward 3 | TM |
| 821 | 257016.1 | 158 | 214 | forward 2 | TM |
| 821 | 257016.1 | 158 | 223 | forward 2 | SP |
| 821 | 257016.1 | 158 | 229 | forward 2 | SP |
| 826 | 477387.3 | 133 | 207 | forward 1 | TM |
| 826 | 477387.3 | 151 | 210 | forward 1 | TM |
| 827 | 477387.7 | 605 | 658 | forward 2 | TM |
| 827 | 477387.7 | 1150 | 1221 | forward 1 | TM |
| 827 | 477387.7 | 1060 | 1122 | forward 1 | TM |
| 827 | 477387.7 | 1165 | 1224 | forward 1 | TM |
| 827 | 477387.7 | 1144 | 1227 | forward 1 | SP |
| 827 | 477387.7 | 1144 | 1200 | forward 1 | SP |
| 827 | 477387.7 | 1144 | 1212 | forward 1 | SP |
| 827 | 477387.7 | 1144 | 1206 | forward 1 | SP |
| 827 | 477387.7 | 1144 | 1215 | forward 1 | SP |
| 828 | 347796.7 | 2548 | 2631 | forward 1 | TM |
| 828 | 347796.7 | 2676 | 2741 | forward 3 | TM |
| 828 | 347796.7 | 3600 | 3671 | forward 3 | TM |
| 828 | 347796.7 | 3618 | 3668 | forward 3 | TM |
| 828 | 347796.7 | 2691 | 2762 | forward 3 | TM |
| 828 | 347796.7 | 2494 | 2544 | forward 1 | TM |
| 828 | 347796.7 | 3663 | 3719 | forward 3 | TM |
| 828 | 347796.7 | 2679 | 2735 | forward 3 | TM |
| 834 | 2649071CD1 | 1 | 23 | | SP |
| 834 | 2649071CD1 | 148 | 163 | | TM |
| 834 | 2649071CD1 | 1 | 16 | | SP |
| 834 | 2649071CD1 | 1 | 18 | | SP |
| 834 | 2649071CD1 | 1 | 20 | | SP |
| 834 | 2649071CD1 | 1 | 23 | | SP |
| 837 | 1850670CD1 | 1 | 23 | | SP |
| 837 | 1850670CD1 | 1 | 18 | | SP |
| 838 | 1132386.3 | 761 | 829 | forward 2 | SP |
| 838 | 1132386.3 | 231 | 302 | forward 3 | SP |
| 842 | 199788.2 | 2388 | 2432 | forward 3 | SP |
| 842 | 199788.2 | 2700 | 2762 | forward 3 | TM |
| 842 | 199788.2 | 2388 | 2444 | forward 3 | TM |
| 843 | 27881.1 | 570 | 632 | forward 3 | TM |
| 843 | 27881.1 | 83 | 130 | forward 2 | TM |
| 843 | 27881.1 | 83 | 148 | forward 2 | SP |
| 844 | 234543.1 | 393 | 455 | forward 3 | TM |
| 844 | 234543.1 | 235 | 294 | forward 1 | SP |
| 844 | 234543.1 | 381 | 455 | forward 3 | TM |
| 844 | 234543.1 | 380 | 451 | forward 2 | SP |
| 844 | 234543.1 | 390 | 443 | forward 3 | TM |
| 844 | 234543.1 | 3205 | 3282 | forward 1 | TM |
| 844 | 234543.1 | 3020 | 3091 | forward 2 | TM |
| 844 | 234543.1 | 389 | 442 | forward 2 | TM |
| 844 | 234543.1 | 380 | 445 | forward 2 | SP |
| 844 | 234543.1 | 375 | 446 | forward 3 | TM |
| 844 | 234543.1 | 388 | 447 | forward 1 | TM |
| 844 | 234543.1 | 380 | 451 | forward 2 | TM |
| 844 | 234543.1 | 381 | 440 | forward 3 | TM |
| 844 | 234543.1 | 380 | 436 | forward 2 | TM |
| 847 | 10498.24 | 4316 | 4369 | forward 2 | SP |
| 847 | 10498.24 | 351 | 404 | forward 3 | TM |
| 847 | 10498.24 | 3895 | 3957 | forward 1 | SP |
| 847 | 10498.24 | 3895 | 3951 | forward 1 | SP |
| 848 | 399161.1 | 449 | 517 | forward 2 | SP |
| 850 | 997194.1 | 1493 | 1579 | forward 2 | SP |
| 856 | 977532.9 | 2193 | 2240 | forward 3 | TM |
| 856 | 977532.9 | 2103 | 2165 | forward 3 | TM |
| 856 | 977532.9 | 3328 | 3384 | forward 1 | TM |
| 856 | 977532.9 | 959 | 1039 | forward 2 | SP |
| 856 | 977532.9 | 968 | 1024 | forward 2 | SP |
| 856 | 977532.9 | 968 | 1027 | forward 2 | SP |
| 856 | 977532.9 | 2683 | 2742 | forward 1 | TM |
| 856 | 977532.9 | 2695 | 2742 | forward 1 | TM |
| 856 | 977532.9 | 2060 | 2122 | forward 2 | TM |
| 856 | 977532.9 | 1515 | 1574 | forward 3 | TM |
| 856 | 977532.9 | 2060 | 2119 | forward 2 | TM |
| 856 | 977532.9 | 968 | 1039 | forward 2 | SP |
| 856 | 977532.9 | 959 | 1030 | forward 2 | SP |
| 856 | 977532.9 | 2072 | 2137 | forward 2 | TM |
| 861 | 1073168.6 | 1042 | 1101 | forward 1 | SP |
| 862 | 1073168.8 | 2643 | 2732 | forward 3 | SP |
| 862 | 1073168.8 | 1655 | 1714 | forward 2 | SP |
| 862 | 1073168.8 | 5065 | 5127 | forward 1 | TM |
| 862 | 1073168.8 | 5080 | 5139 | forward 1 | SP |
| 862 | 1073168.8 | 4483 | 4575 | forward 1 | SP |
| 862 | 1073168.8 | 4265 | 4336 | forward 2 | TM |
| 862 | 1073168.8 | 4283 | 4339 | forward 2 | TM |
| 862 | 1073168.8 | 2378 | 2449 | forward 2 | SP |
| 862 | 1073168.8 | 5068 | 5121 | forward 1 | TM |
| 864 | 119625.1 | 31 | 102 | forward 1 | TM |
| 864 | 119625.1 | 1 | 54 | forward 1 | TM |
| 864 | 119625.1 | 31 | 90 | forward 1 | TM |
| 865 | 119671.1 | 270 | 320 | forward 3 | SP |
| 866 | 3177.1 | 118 | 189 | forward 1 | TM |
| 866 | 3177.1 | 1046 | 1114 | forward 2 | TM |
| 866 | 3177.1 | 1037 | 1099 | forward 2 | TM |
| 866 | 3177.1 | 1033 | 1080 | forward 2 | TM |
| 866 | 3177.1 | 1051 | 1110 | forward 1 | TM |
| 866 | 3177.1 | 1046 | 1117 | forward 2 | TM |
| 866 | 3177.1 | 1039 | 1110 | forward 1 | TM |
| 866 | 3177.1 | 1039 | 1101 | forward 1 | TM |
| 866 | 3177.1 | 1055 | 1108 | forward 2 | TM |
| 868 | 120831.1 | 732 | 797 | forward 3 | SP |
| 868 | 120831.1 | 368 | 454 | forward 2 | TM |
| 868 | 120831.1 | 233 | 286 | forward 2 | SP |
| 868 | 120831.1 | 732 | 785 | forward 3 | SP |
| 869 | 27619.3 | 101 | 175 | forward 2 | SP |
| 869 | 27619.3 | 462 | 530 | forward 3 | SP |
| 869 | 27619.3 | 210 | 281 | forward 3 | SP |

TABLE 4-continued

| SEQ ID NO | Template ID | Start | Stop | Frame | Hit Type |
|---|---|---|---|---|---|
| 869 | 27619.3 | 101 | 190 | forward 2 | SP |
| 870 | 212872.1 | 462 | 527 | forward 3 | SP |
| 870 | 212872.1 | 462 | 521 | forward 3 | SP |
| 872 | 404952.1 | 2266 | 2325 | forward 1 | SP |
| 872 | 404952.1 | 316 | 390 | forward 1 | SP |
| 872 | 404952.1 | 3055 | 3129 | forward 1 | SP |
| 872 | 404952.1 | 3036 | 3092 | forward 3 | TM |
| 872 | 404952.1 | 3891 | 3968 | forward 3 | TM |
| 872 | 404952.1 | 3067 | 3129 | forward 1 | SP |
| 872 | 404952.1 | 3070 | 3141 | forward 1 | TM |
| 872 | 404952.1 | 1547 | 1597 | forward 2 | SP |
| 872 | 404952.1 | 3293 | 3373 | forward 2 | TM |
| 872 | 404952.1 | 3702 | 3758 | forward 3 | TM |
| 872 | 404952.1 | 2944 | 2994 | forward 1 | TM |
| 872 | 404952.1 | 3891 | 3938 | forward 3 | TM |
| 872 | 404952.1 | 3085 | 3129 | forward 1 | SP |
| 872 | 404952.1 | 2284 | 2346 | forward 1 | TM |
| 872 | 404952.1 | 3097 | 3159 | forward 1 | TM |
| 872 | 404952.1 | 3076 | 3129 | forward 1 | SP |
| 872 | 404952.1 | 3124 | 3180 | forward 1 | TM |
| 872 | 404952.1 | 3025 | 3129 | forward 1 | SP |
| 872 | 404952.1 | 3091 | 3165 | forward 1 | TM |
| 872 | 404952.1 | 3073 | 3147 | forward 1 | TM |
| 872 | 404952.1 | 3097 | 3153 | forward 1 | TM |
| 875 | 227222.1 | 32 | 100 | forward 2 | SP |
| 875 | 227222.1 | 177 | 254 | forward 3 | TM |
| 877 | 253550.2 | 412 | 471 | forward 1 | SP |
| 878 | 1326925.1 | 527 | 589 | forward 2 | TM |
| 878 | 1326925.1 | 890 | 955 | forward 2 | TM |
| 881 | 330925.1 | 584 | 652 | forward 2 | SP |
| 881 | 330925.1 | 735 | 809 | forward 3 | SP |
| 885 | 399474.1 | 3772 | 3816 | forward 1 | SP |
| 885 | 399474.1 | 3772 | 3840 | forward 1 | SP |
| 885 | 399474.1 | 3029 | 3100 | forward 2 | TM |
| 885 | 399474.1 | 3035 | 3091 | forward 2 | TM |
| 885 | 399474.1 | 641 | 706 | forward 2 | SP |
| 885 | 399474.1 | 814 | 879 | forward 1 | TM |
| 885 | 399474.1 | 3414 | 3485 | forward 3 | TM |
| 885 | 399474.1 | 3772 | 3828 | forward 1 | SP |
| 885 | 399474.1 | 3772 | 3834 | forward 1 | SP |
| 885 | 399474.1 | 3438 | 3500 | forward 3 | SP |
| 885 | 399474.1 | 2347 | 2415 | forward 1 | SP |
| 885 | 399474.1 | 3043 | 3102 | forward 1 | TM |
| 885 | 399474.1 | 2022 | 2072 | forward 3 | TM |
| 885 | 399474.1 | 647 | 700 | forward 2 | SP |
| 885 | 399474.1 | 2347 | 2409 | forward 1 | SP |
| 885 | 399474.1 | 3049 | 3102 | forward 1 | TM |
| 885 | 399474.1 | 3420 | 3473 | forward 3 | TM |
| 885 | 399474.1 | 3423 | 3488 | forward 3 | TM |
| 885 | 399474.1 | 3046 | 3123 | forward 1 | TM |
| 885 | 399474.1 | 641 | 703 | forward 2 | SP |
| 885 | 399474.1 | 2347 | 2421 | forward 1 | SP |
| 885 | 399474.1 | 2347 | 2403 | forward 1 | SP |
| 887 | 130502.1 | 497 | 565 | forward 2 | SP |
| 887 | 130502.1 | 512 | 568 | forward 2 | TM |
| 887 | 130502.1 | 506 | 559 | forward 2 | SP |
| 887 | 130502.1 | 512 | 562 | forward 2 | TM |
| 894 | 256026.8 | 301 | 360 | forward 1 | TM |
| 894 | 256026.8 | 344 | 424 | forward 2 | TM |
| 895 | 998930.1 | 42 | 128 | forward 3 | SP |
| 895 | 998930.1 | 44 | 94 | forward 2 | TM |
| 895 | 998930.1 | 234 | 293 | forward 3 | SP |
| 895 | 998930.1 | 50 | 103 | forward 2 | SP |
| 895 | 998930.1 | 50 | 109 | forward 2 | SP |
| 895 | 998930.1 | 50 | 94 | forward 2 | SP |
| 896 | 981149.2 | 60 | 137 | forward 3 | TM |
| 899 | 225420.1 | 237 | 347 | forward 3 | SP |
| 899 | 225420.1 | 3434 | 3505 | forward 3 | TM |
| 899 | 225420.1 | 3393 | 3458 | forward 3 | TM |
| 899 | 225420.1 | 3393 | 3464 | forward 3 | TM |
| 899 | 225420.1 | 3714 | 3767 | forward 3 | SP |
| 899 | 225420.1 | 876 | 956 | forward 3 | SP |
| 899 | 225420.1 | 3383 | 3439 | forward 2 | SP |
| 899 | 225420.1 | 3383 | 3448 | forward 2 | SP |
| 899 | 225420.1 | 3714 | 3773 | forward 3 | SP |
| 899 | 225420.1 | 3734 | 3787 | forward 2 | TM |
| 899 | 225420.1 | 3532 | 3603 | forward 1 | TM |
| 899 | 225420.1 | 3428 | 3487 | forward 2 | TM |
| 899 | 225420.1 | 3393 | 3449 | forward 3 | TM |
| 899 | 225420.1 | 3714 | 3779 | forward 3 | SP |
| 900 | 236298.4 | 731 | 811 | forward 2 | TM |
| 900 | 236298.4 | 872 | 934 | forward 2 | TM |
| 900 | 236298.4 | 869 | 916 | forward 2 | TM |
| 900 | 236298.4 | 1266 | 1316 | forward 3 | TM |
| 900 | 236298.4 | 1481 | 1531 | forward 2 | TM |
| 900 | 236298.4 | 1843 | 1899 | forward 1 | TM |
| 900 | 236298.4 | 860 | 916 | forward 2 | TM |
| 901 | 236298.2 | 1060 | 1119 | forward 1 | TM |
| 901 | 236298.2 | 1147 | 1197 | forward 1 | TM |
| 904 | 477054.1 | 591 | 650 | forward 3 | SP |
| 905 | 2966.1 | 148 | 222 | forward 1 | SP |
| 905 | 2966.1 | 148 | 201 | forward 1 | TM |
| 905 | 2966.1 | 172 | 243 | forward 1 | TM |
| 906 | 136212.1 | 29 | 106 | forward 2 | SP |
| 906 | 136212.1 | 280 | 351 | forward 1 | SP |
| 906 | 136212.1 | 280 | 357 | forward 1 | SP |
| 907 | 977975.1 | 5142 | 5195 | forward 3 | TM |
| 907 | 977975.1 | 4335 | 4421 | forward 3 | SP |
| 907 | 977975.1 | 4344 | 4406 | forward 3 | TM |
| 907 | 977975.1 | 4507 | 4566 | forward 1 | TM |
| 907 | 977975.1 | 4368 | 4418 | forward 3 | TM |
| 909 | 1505038CD1 | 1 | 22 | | SP |
| 909 | 1505038CD1 | 1 | 18 | | SP |
| 909 | 1505038CD1 | 1 | 16 | | SP |
| 909 | 1505038CD1 | 1 | 20 | | SP |
| 911 | 262830CD1 | 1 | 18 | | SP |
| 911 | 262830CD1 | 1 | 22 | | SP |
| 911 | 262830CD1 | 1 | 24 | | SP |
| 913 | 3607580CD1 | 116 | 135 | | TM |
| 913 | 3607580CD1 | 213 | 232 | | TM |
| 913 | 3607580CD1 | 50 | 69 | | TM |
| 913 | 3607580CD1 | 257 | 276 | | SP |
| 913 | 3607580CD1 | 274 | 294 | | TM |
| 913 | 3607580CD1 | 49 | 66 | | TM |
| 913 | 3607580CD1 | 79 | 103 | | TM |
| 913 | 3607580CD1 | 49 | 70 | | TM |
| 913 | 3607580CD1 | 52 | 72 | | TM |
| 913 | 3607580CD1 | 49 | 72 | | TM |
| 914 | 137742.1 | 109 | 171 | forward 1 | TM |
| 914 | 137742.1 | 88 | 159 | forward 1 | TM |
| 914 | 137742.1 | 94 | 165 | forward 1 | TM |
| 914 | 137742.1 | 115 | 165 | forward 1 | TM |
| 914 | 137742.1 | 103 | 165 | forward 1 | TM |
| 915 | 1095839.1 | 3222 | 3278 | forward 3 | TM |
| 915 | 1095839.1 | 331 | 390 | forward 1 | SP |
| 915 | 1095839.1 | 1407 | 1484 | forward 3 | TM |
| 915 | 1095839.1 | 322 | 390 | forward 1 | SP |
| 915 | 1095839.1 | 322 | 378 | forward 1 | SP |
| 915 | 1095839.1 | 322 | 396 | forward 1 | SP |
| 916 | 205328.1 | 101 | 163 | forward 2 | TM |
| 920 | 331566.1 | 2204 | 2272 | forward 2 | TM |
| 920 | 331566.1 | 5188 | 5250 | forward 1 | TM |
| 920 | 331566.1 | 590 | 646 | forward 2 | TM |
| 920 | 331566.1 | 5252 | 5329 | forward 2 | SP |
| 920 | 331566.1 | 2240 | 2302 | forward 2 | SP |
| 920 | 331566.1 | 1293 | 1346 | forward 3 | TM |
| 920 | 331566.1 | 3118 | 3180 | forward 1 | SP |
| 920 | 331566.1 | 1135 | 1197 | forward 1 | TM |
| 920 | 331566.1 | 3094 | 3162 | forward 1 | TM |
| 920 | 331566.1 | 5258 | 5308 | forward 2 | TM |
| 920 | 331566.1 | 5132 | 5188 | forward 2 | TM |
| 920 | 331566.1 | 5252 | 5311 | forward 2 | TM |
| 920 | 331566.1 | 1791 | 1862 | forward 3 | TM |
| 920 | 331566.1 | 5252 | 5317 | forward 2 | SP |
| 920 | 331566.1 | 2219 | 2272 | forward 2 | TM |
| 920 | 331566.1 | 2213 | 2272 | forward 2 | TM |
| 920 | 331566.1 | 407 | 466 | forward 2 | SP |
| 920 | 331566.1 | 407 | 451 | forward 2 | SP |
| 920 | 331566.1 | 407 | 460 | forward 2 | SP |
| 921 | 1384719.3 | 2975 | 3046 | forward 2 | TM |
| 921 | 1384719.3 | 3241 | 3312 | forward 1 | TM |
| 921 | 1384719.3 | 1086 | 1154 | forward 3 | SP |
| 921 | 1384719.3 | 2613 | 2702 | forward 3 | SP |
| 921 | 1384719.3 | 3351 | 3422 | forward 3 | TM |

TABLE 4-continued

| SEQ ID NO | Template ID | Start | Stop | Frame | Hit Type |
|---|---|---|---|---|---|
| 921 | 1384719.3 | 3214 | 3273 | forward 1 | TM |
| 921 | 1384719.3 | 1086 | 1148 | forward 3 | SP |
| 921 | 1384719.3 | 2999 | 3052 | forward 2 | SP |
| 921 | 1384719.3 | 2637 | 2696 | forward 3 | TM |
| 921 | 1384719.3 | 3336 | 3410 | forward 3 | TM |
| 921 | 1384719.3 | 2014 | 2088 | forward 1 | TM |
| 921 | 1384719.3 | 2999 | 3046 | forward 2 | SP |
| 921 | 1384719.3 | 180 | 233 | forward 3 | TM |
| 921 | 1384719.3 | 3204 | 3263 | forward 3 | TM |
| 921 | 1384719.3 | 2978 | 3055 | forward 2 | TM |
| 921 | 1384719.3 | 3348 | 3410 | forward 3 | TM |
| 921 | 1384719.3 | 1086 | 1157 | forward 3 | SP |
| 921 | 1384719.3 | 3366 | 3419 | forward 3 | TM |
| 921 | 1384719.3 | 3360 | 3419 | forward 3 | TM |
| 924 | 481118.7 | 2287 | 2343 | forward 1 | SP |
| 925 | 481118.12 | 2152 | 2205 | forward 1 | SP |
| 925 | 481118.12 | 2158 | 2205 | forward 1 | SP |
| 925 | 481118.12 | 2588 | 2659 | forward 2 | TM |
| 925 | 481118.12 | 2146 | 2196 | forward 1 | TM |
| 925 | 481118.12 | 2275 | 2337 | forward 1 | TM |
| 926 | 337528.4 | 1011 | 1097 | forward 3 | TM |
| 926 | 337528.4 | 210 | 290 | forward 3 | TM |
| 926 | 337528.4 | 213 | 266 | forward 3 | SP |
| 929 | 332299.1 | 582 | 647 | forward 3 | TM |
| 929 | 332299.1 | 686 | 766 | forward 2 | TM |
| 929 | 332299.1 | 698 | 757 | forward 2 | TM |
| 931 | 1530186CD1 | 313 | 336 | | TM |
| 931 | 1530186CD1 | 317 | 342 | | TM |
| 931 | 1530186CD1 | 158 | 181 | | TM |
| 931 | 1530186CD1 | 222 | 240 | | TM |
| 931 | 1530186CD1 | 261 | 281 | | TM |
| 931 | 1530186CD1 | 193 | 210 | | SP |
| 931 | 1530186CD1 | 193 | 213 | | SP |
| 931 | 1530186CD1 | 193 | 214 | | SP |
| 931 | 1530186CD1 | 318 | 336 | | TM |
| 933 | 334025.5 | 303 | 371 | forward 3 | TM |
| 939 | 1400580.1 | 901 | 951 | forward 1 | TM |
| 939 | 1400580.1 | 898 | 960 | forward 1 | TM |
| 939 | 1400580.1 | 901 | 957 | forward 1 | TM |
| 939 | 1400580.1 | 901 | 969 | forward 1 | TM |
| 940 | 481154.3 | 2641 | 2703 | forward 1 | SP |
| 940 | 481154.3 | 2620 | 2703 | forward 1 | SP |
| 941 | 346716.17 | 270 | 365 | forward 3 | SP |
| 942 | 346716.21 | 815 | 895 | forward 2 | SP |
| 943 | 1384720.16 | 649 | 708 | forward 1 | TM |
| 943 | 1384720.16 | 2320 | 2376 | forward 1 | TM |
| 943 | 1384720.16 | 664 | 756 | forward 1 | SP |
| 943 | 1384720.16 | 2533 | 2604 | forward 1 | SP |
| 943 | 1384720.16 | 646 | 705 | forward 1 | TM |
| 947 | 3876162CD1 | 1 | 28 | | SP |
| 947 | 3876162CD1 | 1 | 19 | | SP |
| 947 | 3876162CD1 | 1 | 19 | | SP |
| 947 | 3876162CD1 | 463 | 487 | | SP |
| 947 | 3876162CD1 | 470 | 487 | | TM |
| 948 | 40576.1 | 364 | 447 | forward 1 | TM |
| 948 | 40576.1 | 342 | 425 | forward 3 | SP |
| 948 | 40576.1 | 342 | 401 | forward 3 | SP |
| 948 | 40576.1 | 407 | 457 | forward 2 | SP |
| 948 | 40576.1 | 151 | 210 | forward 1 | TM |
| 948 | 40576.1 | 407 | 463 | forward 2 | TM |
| 948 | 40576.1 | 407 | 478 | forward 2 | SP |
| 948 | 40576.1 | 407 | 463 | forward 2 | SP |
| 948 | 40576.1 | 1320 | 1394 | forward 3 | TM |
| 948 | 40576.1 | 407 | 466 | forward 2 | SP |
| 948 | 40576.1 | 407 | 472 | forward 2 | SP |
| 953 | 42206.1 | 68 | 124 | forward 2 | SP |
| 953 | 42206.1 | 47 | 106 | forward 2 | TM |
| 954 | 178799.1 | 695 | 751 | forward 2 | TM |
| 956 | 94384.1 | 359 | 418 | forward 2 | TM |
| 958 | 2852561CD1 | 78 | 98 | | SP |
| 958 | 2852561CD1 | 77 | 99 | | SP |
| 958 | 2852561CD1 | 84 | 104 | | TM |
| 958 | 2852561CD1 | 79 | 106 | | SP |
| 958 | 2852561CD1 | 75 | 99 | | SP |
| 958 | 2852561CD1 | 84 | 105 | | TM |
| 959 | 337058.1 | 1685 | 1735 | forward 2 | TM |
| 960 | 988704.25 | 2022 | 2081 | forward 3 | TM |
| 960 | 988704.25 | 998 | 1051 | forward 2 | TM |
| 960 | 988704.25 | 1196 | 1252 | forward 2 | TM |
| 960 | 988704.25 | 1802 | 1864 | forward 2 | SP |
| 960 | 988704.25 | 1196 | 1261 | forward 2 | TM |
| 960 | 988704.25 | 1181 | 1234 | forward 2 | SP |
| 960 | 988704.25 | 2805 | 2861 | forward 3 | TM |
| 960 | 988704.25 | 1793 | 1858 | forward 2 | TM |
| 960 | 988704.25 | 1004 | 1069 | forward 2 | TM |
| 960 | 988704.25 | 2032 | 2103 | forward 1 | TM |
| 960 | 988704.25 | 1995 | 2063 | forward 3 | SP |
| 960 | 988704.25 | 1784 | 1858 | forward 2 | TM |
| 960 | 988704.25 | 1796 | 1849 | forward 2 | TM |
| 960 | 988704.25 | 1793 | 1849 | forward 2 | TM |
| 961 | 988704.26 | 1233 | 1289 | forward 3 | TM |
| 962 | 401906.2 | 42 | 131 | forward 3 | SP |
| 965 | 5371205CD1 | 349 | 363 | | SP |
| 966 | 147026.1 | 219 | 269 | forward 3 | TM |
| 966 | 147026.1 | 234 | 305 | forward 3 | TM |
| 966 | 147026.1 | 88 | 147 | forward 1 | SP |
| 966 | 147026.1 | 88 | 156 | forward 1 | SP |
| 966 | 147026.1 | 249 | 308 | forward 3 | TM |
| 966 | 147026.1 | 109 | 162 | forward 1 | SP |
| 967 | 410776.1 | 582 | 638 | forward 3 | SP |
| 968 | 335121.1 | 34 | 105 | forward 1 | TM |
| 970 | 147403.1 | 949 | 1005 | forward 1 | TM |
| 970 | 147403.1 | 624 | 689 | forward 3 | SP |
| 970 | 147403.1 | 624 | 698 | forward 3 | SP |
| 970 | 147403.1 | 443 | 490 | forward 2 | TM |
| 972 | 1041063.5 | 408 | 461 | forward 3 | TM |
| 972 | 1041063.5 | 372 | 458 | forward 3 | TM |
| 973 | 230912.1 | 240 | 305 | forward 3 | SP |
| 973 | 230912.1 | 237 | 308 | forward 3 | SP |
| 973 | 230912.1 | 243 | 305 | forward 3 | SP |
| 973 | 230912.1 | 243 | 299 | forward 3 | SP |
| 973 | 230912.1 | 213 | 305 | forward 3 | SP |
| 974 | 1089708.18 | 4654 | 4728 | forward 1 | TM |
| 974 | 1089708.18 | 3604 | 3657 | forward 1 | TM |
| 974 | 1089708.18 | 3601 | 3669 | forward 1 | TM |
| 974 | 1089708.18 | 3598 | 3657 | forward 1 | TM |
| 974 | 1089708.18 | 5653 | 5739 | forward 1 | SP |
| 974 | 1089708.18 | 4708 | 4764 | forward 1 | TM |
| 977 | 088957CD1 | 1 | 16 | | SP |
| 977 | 088957CD1 | 1 | 20 | | SP |
| 977 | 088957CD1 | 1 | 18 | | SP |
| 978 | 220943.21 | 3318 | 3389 | forward 3 | TM |
| 978 | 220943.21 | 3314 | 3373 | forward 2 | TM |
| 978 | 220943.21 | 3299 | 3358 | forward 2 | SP |
| 978 | 220943.21 | 2316 | 2390 | forward 3 | TM |
| 978 | 220943.21 | 3299 | 3355 | forward 2 | SP |
| 978 | 220943.21 | 3299 | 3364 | forward 2 | SP |
| 978 | 220943.21 | 2343 | 2396 | forward 3 | SP |
| 978 | 220943.21 | 3319 | 3375 | forward 1 | TM |
| 978 | 220943.21 | 2340 | 2396 | forward 3 | TM |
| 978 | 220943.21 | 3313 | 3384 | forward 1 | TM |
| 978 | 220943.21 | 2313 | 2396 | forward 3 | TM |
| 978 | 220943.21 | 2310 | 2378 | forward 3 | TM |
| 980 | 980446.1 | 380 | 454 | forward 2 | TM |
| 980 | 980446.1 | 61 | 120 | forward 1 | TM |
| 980 | 980446.1 | 374 | 436 | forward 2 | SP |
| 980 | 980446.1 | 374 | 424 | forward 2 | SP |
| 980 | 980446.1 | 49 | 135 | forward 1 | TM |
| 980 | 980446.1 | 374 | 427 | forward 2 | SP |
| 980 | 980446.1 | 287 | 346 | forward 2 | TM |
| 980 | 980446.1 | 371 | 427 | forward 2 | TM |
| 980 | 980446.1 | 371 | 424 | forward 2 | TM |
| 980 | 980446.1 | 374 | 436 | forward 2 | SP |
| 980 | 980446.1 | 272 | 343 | forward 2 | TM |
| 981 | 198827.1 | 243 | 314 | forward 3 | SP |
| 981 | 198827.1 | 243 | 302 | forward 3 | SP |
| 981 | 198827.1 | 243 | 287 | forward 3 | SP |
| 981 | 198827.1 | 243 | 311 | forward 3 | SP |
| 981 | 198827.1 | 243 | 299 | forward 3 | SP |
| 982 | 215112.1 | 434 | 490 | forward 2 | TM |
| 983 | 977929.1 | 2216 | 2287 | forward 2 | TM |
| 983 | 977929.1 | 1284 | 1346 | forward 3 | SP |
| 983 | 977929.1 | 2405 | 2452 | forward 2 | TM |
| 983 | 977929.1 | 1284 | 1355 | forward 3 | SP |

TABLE 4-continued

| SEQ ID NO | Template ID | Start | Stop | Frame | Hit Type |
|---|---|---|---|---|---|
| 983 | 977929.1 | 1284 | 1337 | forward 3 | SP |
| 983 | 977929.1 | 1284 | 1349 | forward 3 | SP |
| 983 | 977929.1 | 2399 | 2455 | forward 2 | TM |
| 983 | 977929.1 | 1284 | 1379 | forward 3 | SP |
| 983 | 977929.1 | 2390 | 2461 | forward 2 | TM |
| 984 | 281447.2 | 260 | 316 | forward 2 | TM |
| 985 | 346641.3 | 1501 | 1575 | forward 1 | SP |
| 985 | 346641.3 | 1553 | 1615 | forward 2 | TM |
| 985 | 346641.3 | 1507 | 1587 | forward 1 | TM |
| 985 | 346641.3 | 1501 | 1560 | forward 1 | SP |
| 985 | 346641.3 | 1501 | 1590 | forward 1 | SP |
| 985 | 346641.3 | 1546 | 1608 | forward 1 | TM |
| 985 | 346641.3 | 1537 | 1590 | forward 1 | TM |
| 985 | 346641.3 | 1537 | 1605 | forward 1 | TM |
| 985 | 346641.3 | 1528 | 1584 | forward 1 | TM |
| 986 | 230793.3 | 1921 | 1977 | forward 1 | TM |
| 986 | 230793.3 | 231 | 305 | forward 3 | SP |
| 986 | 230793.3 | 1897 | 1965 | forward 1 | TM |
| 986 | 230793.3 | 1955 | 2011 | forward 2 | TM |
| 986 | 230793.3 | 1900 | 1980 | forward 1 | TM |
| 986 | 230793.3 | 231 | 299 | forward 3 | SP |
| 986 | 230793.3 | 883 | 945 | forward 1 | TM |
| 986 | 230793.3 | 1909 | 1980 | forward 1 | TM |
| 986 | 230793.3 | 1414 | 1470 | forward 1 | TM |
| 986 | 230793.3 | 1912 | 1974 | forward 1 | TM |
| 989 | 4215034CD1 | 127 | 146 | | TM |
| 989 | 4215034CD1 | 122 | 137 | | TM |
| 989 | 4215034CD1 | 122 | 146 | | SP |
| 995 | 8835.1 | 277 | 360 | forward 1 | SP |
| 996 | 242010.6 | 1613 | 1666 | forward 2 | TM |
| 996 | 242010.6 | 1427 | 1480 | forward 2 | SP |
| 998 | 335145.1 | 1824 | 1892 | forward 3 | TM |
| 998 | 335145.1 | 1818 | 1877 | forward 3 | TM |
| 998 | 335145.1 | 1857 | 1937 | forward 3 | TM |
| 998 | 335145.1 | 1824 | 1886 | forward 3 | TM |
| 998 | 335145.1 | 1845 | 1895 | forward 3 | TM |
| 1002 | 411373.7 | 2216 | 2275 | forward 2 | TM |
| 1002 | 411373.7 | 281 | 343 | forward 2 | SP |
| 1002 | 411373.7 | 1206 | 1268 | forward 3 | SP |
| 1002 | 411373.7 | 2207 | 2275 | forward 2 | TM |
| 1002 | 411373.7 | 281 | 334 | forward 2 | SP |
| 1003 | 404715.1 | 775 | 840 | forward 1 | SP |
| 1003 | 404715.1 | 772 | 846 | forward 1 | SP |
| 1003 | 404715.1 | 772 | 852 | forward 1 | SP |
| 1003 | 404715.1 | 792 | 851 | forward 3 | SP |
| 1004 | 278831.1 | 201 | 272 | forward 3 | TM |
| 1004 | 278831.1 | 225 | 281 | forward 3 | SP |
| 1004 | 278831.1 | 240 | 305 | forward 3 | SP |
| 1004 | 278831.1 | 219 | 281 | forward 3 | TM |
| 1004 | 278831.1 | 231 | 284 | forward 3 | TM |
| 1004 | 278831.1 | 225 | 302 | forward 3 | TM |
| 1004 | 278831.1 | 228 | 287 | forward 3 | TM |
| 1006 | 200977.1 | 1686 | 1733 | forward 3 | TM |
| 1006 | 200977.1 | 239 | 310 | forward 2 | TM |
| 1006 | 200977.1 | 2212 | 2262 | forward 1 | TM |
| 1006 | 200977.1 | 149 | 202 | forward 2 | TM |
| 1009 | 029251CD1 | 1 | 22 | | SP |
| 1010 | 335648.1 | 2607 | 2663 | forward 3 | TM |
| 1010 | 335648.1 | 2551 | 2619 | forward 1 | TM |
| 1010 | 335648.1 | 2162 | 2224 | forward 2 | TM |
| 1010 | 335648.1 | 2572 | 2655 | forward 1 | TM |
| 1010 | 335648.1 | 2581 | 2634 | forward 1 | TM |
| 1010 | 335648.1 | 2156 | 2218 | forward 2 | TM |
| 1010 | 335648.1 | 2640 | 2702 | forward 3 | TM |
| 1010 | 335648.1 | 2593 | 2652 | forward 1 | TM |
| 1010 | 335648.1 | 2156 | 2212 | forward 2 | SP |
| 1010 | 335648.1 | 1262 | 1330 | forward 2 | SP |
| 1011 | 331108.1 | 9992 | 10054 | forward 2 | SP |
| 1011 | 331108.1 | 101 | 169 | forward 2 | SP |
| 1011 | 331108.1 | 13181 | 13234 | forward 2 | TM |
| 1011 | 331108.1 | 6866 | 6922 | forward 2 | TM |
| 1012 | 333840.1 | 1902 | 1991 | forward 3 | SP |
| 1012 | 333840.1 | 704 | 760 | forward 2 | TM |
| 1012 | 333840.1 | 573 | 644 | forward 3 | SP |
| 1012 | 333840.1 | 1932 | 1982 | forward 3 | SP |
| 1012 | 333840.1 | 704 | 757 | forward 2 | TM |
| 1012 | 333840.1 | 573 | 644 | forward 3 | SP |
| 1012 | 333840.1 | 1932 | 1985 | forward 3 | SP |
| 1012 | 333840.1 | 1932 | 1991 | forward 3 | SP |
| 1012 | 333840.1 | 1932 | 2000 | forward 3 | SP |
| 1013 | 334298.1 | 669 | 734 | forward 3 | SP |
| 1013 | 334298.1 | 63 | 149 | forward 3 | TM |
| 1013 | 334298.1 | 57 | 116 | forward 3 | SP |
| 1013 | 334298.1 | 57 | 122 | forward 3 | TM |
| 1013 | 334298.1 | 27 | 89 | forward 3 | TM |
| 1013 | 334298.1 | 3 | 65 | forward 3 | TM |
| 1013 | 334298.1 | 156 | 215 | forward 3 | TM |
| 1013 | 334298.1 | 21 | 95 | forward 3 | TM |
| 1013 | 334298.1 | 69 | 128 | forward 3 | TM |
| 1015 | 1262593.2 | 2388 | 2435 | forward 3 | SP |
| 1015 | 1262593.2 | 2390 | 2446 | forward 2 | TM |
| 1015 | 1262593.2 | 1320 | 1370 | forward 3 | TM |
| 1015 | 1262593.2 | 2373 | 2435 | forward 3 | TM |
| 1015 | 1262593.2 | 2388 | 2441 | forward 3 | SP |
| 1015 | 1262593.2 | 2379 | 2426 | forward 2 | TM |
| 1015 | 1262593.2 | 946 | 1008 | forward 1 | TM |
| 1015 | 1262593.2 | 2373 | 2426 | forward 3 | TM |
| 1016 | 461375.2 | 3926 | 4042 | forward 2 | SP |
| 1016 | 461375.2 | 3971 | 4027 | forward 2 | TM |
| 1016 | 461375.2 | 3822 | 3881 | forward 3 | SP |
| 1016 | 461375.2 | 689 | 784 | forward 2 | SP |
| 1016 | 461375.2 | 4209 | 4265 | forward 3 | TM |
| 1016 | 461375.2 | 4179 | 4241 | forward 3 | TM |
| 1016 | 461375.2 | 3956 | 4027 | forward 2 | TM |
| 1016 | 461375.2 | 689 | 754 | forward 2 | SP |
| 1017 | 233660.2 | 1841 | 1888 | forward 2 | TM |
| 1017 | 233660.2 | 4505 | 4564 | forward 2 | SP |
| 1017 | 233660.2 | 5275 | 5331 | forward 1 | TM |
| 1017 | 233660.2 | 1985 | 2050 | forward 2 | SP |
| 1017 | 233660.2 | 1994 | 2044 | forward 2 | SP |
| 1017 | 233660.2 | 2621 | 2707 | forward 2 | TM |
| 1017 | 233660.2 | 1985 | 2044 | forward 2 | SP |
| 1017 | 233660.2 | 5230 | 5316 | forward 1 | SP |
| 1017 | 233660.2 | 1913 | 1996 | forward 2 | TM |
| 1017 | 233660.2 | 527 | 586 | forward 2 | SP |
| 1017 | 233660.2 | 527 | 601 | forward 2 | SP |
| 1017 | 233660.2 | 536 | 589 | forward 2 | TM |
| 1017 | 233660.2 | 2912 | 2962 | forward 2 | TM |
| 1017 | 233660.2 | 539 | 595 | forward 2 | TM |
| 1017 | 233660.2 | 527 | 595 | forward 2 | SP |
| 1018 | 230179.3 | 2267 | 2359 | forward 2 | SP |
| 1018 | 230179.3 | 1423 | 1491 | forward 1 | SP |
| 1018 | 230179.3 | 1179 | 1268 | forward 3 | SP |
| 1018 | 230179.3 | 1194 | 1268 | forward 3 | SP |
| 1018 | 230179.3 | 1423 | 1485 | forward 1 | SP |
| 1018 | 230179.3 | 1925 | 1987 | forward 2 | SP |
| 1019 | 230179.7 | 402 | 494 | forward 3 | SP |
| 1019 | 230179.7 | 162 | 230 | forward 3 | SP |
| 1019 | 230179.7 | 162 | 224 | forward 3 | SP |
| 1021 | 981208.1 | 669 | 716 | forward 3 | SP |
| 1021 | 981208.1 | 2276 | 2332 | forward 2 | TM |
| 1021 | 981208.1 | 1456 | 1518 | forward 1 | TM |
| 1021 | 981208.1 | 2159 | 2218 | forward 2 | TM |
| 1022 | 406580.1 | 2597 | 2647 | forward 2 | SP |
| 1023 | 200051.1 | 1907 | 1966 | forward 2 | SP |
| 1023 | 200051.1 | 1907 | 1960 | forward 2 | SP |
| 1023 | 200051.1 | 578 | 631 | forward 2 | SP |
| 1023 | 200051.1 | 1796 | 1873 | forward 2 | TM |
| 1023 | 200051.1 | 1796 | 1855 | forward 2 | TM |
| 1024 | 1197030.1 | 1222 | 1305 | forward 1 | SP |
| 1024 | 1197030.1 | 594 | 644 | forward 3 | TM |
| 1024 | 1197030.1 | 603 | 665 | forward 3 | TM |
| 1024 | 1197030.1 | 585 | 641 | forward 3 | TM |
| 1025 | 1197030.1 | 1013 | 1069 | forward 2 | SP |
| 1025 | 1197030.1 | 658 | 741 | forward 1 | SP |
| 1025 | 1197030.1 | 998 | 1066 | forward 2 | SP |
| 1030 | 339638.1 | 55 | 129 | forward 1 | SP |
| 1030 | 339638.1 | 273 | 323 | forward 3 | TM |
| 1030 | 339638.1 | 105 | 176 | forward 3 | TM |
| 1032 | 342074.1 | 147 | 215 | forward 3 | TM |
| 1032 | 342074.1 | 165 | 224 | forward 3 | TM |
| 1032 | 342074.1 | 60 | 128 | forward 3 | SP |
| 1033 | 406992.1 | 163 | 219 | forward 1 | TM |
| 1033 | 406992.1 | 529 | 591 | forward 1 | TM |

TABLE 4-continued

| SEQ ID NO | Template ID | Start | Stop | Frame | Hit Type |
|---|---|---|---|---|---|
| 1033 | 406992.1 | 709 | 768 | forward 1 | TM |
| 1033 | 406992.1 | 538 | 594 | forward 1 | TM |
| 1033 | 406992.1 | 310 | 366 | forward 1 | TM |
| 1033 | 406992.1 | 443 | 505 | forward 2 | SP |
| 1033 | 406992.1 | 436 | 528 | forward 1 | SP |
| 1033 | 406992.1 | 443 | 511 | forward 2 | SP |
| 1033 | 406992.1 | 616 | 693 | forward 1 | SP |
| 1033 | 406992.1 | 166 | 237 | forward 1 | TM |
| 1035 | 1852849CD1 | 1 | 19 | | SP |
| 1035 | 1852849CD1 | 1 | 17 | | SP |
| 1038 | 1399492.1 | 1280 | 1354 | forward 2 | SP |
| 1039 | 13039.2 | 3822 | 3890 | forward 3 | TM |
| 1039 | 13039.2 | 610 | 672 | forward 1 | TM |
| 1039 | 13039.2 | 4688 | 4759 | forward 2 | TM |
| 1039 | 13039.2 | 4362 | 4418 | forward 3 | TM |
| 1039 | 13039.2 | 3828 | 3890 | forward 3 | TM |
| 1039 | 13039.2 | 5778 | 5837 | forward 3 | TM |
| 1039 | 13039.2 | 5216 | 5278 | forward 2 | SP |
| 1039 | 13039.2 | 3917 | 3976 | forward 2 | TM |
| 1039 | 13039.2 | 5772 | 5834 | forward 3 | TM |
| 1039 | 13039.2 | 4084 | 4158 | forward 1 | SP |
| 1039 | 13039.2 | 3828 | 3878 | forward 3 | TM |
| 1039 | 13039.2 | 4084 | 4149 | forward 1 | SP |
| 1039 | 13039.2 | 3834 | 3902 | forward 3 | TM |
| 1039 | 13039.2 | 5216 | 5269 | forward 2 | SP |
| 1039 | 13039.2 | 3837 | 3911 | forward 3 | TM |
| 1039 | 13039.2 | 3837 | 3893 | forward 3 | TM |
| 1039 | 13039.2 | 5766 | 5819 | forward 3 | TM |
| 1040 | 399626.1 | 539 | 613 | forward 2 | TM |
| 1040 | 399626.1 | 340 | 393 | forward 1 | TM |
| 1040 | 399626.1 | 521 | 577 | forward 2 | TM |
| 1041 | 365070.3 | 1252 | 1323 | forward 1 | SP |
| 1041 | 365070.3 | 70 | 135 | forward 1 | SP |
| 1041 | 365070.3 | 82 | 135 | forward 1 | SP |
| 1041 | 365070.3 | 1267 | 1323 | forward 1 | SP |
| 1041 | 365070.3 | 43 | 135 | forward 1 | SP |
| 1044 | 1383263.14 | 624 | 683 | forward 3 | SP |
| 1044 | 1383263.14 | 107 | 172 | forward 2 | SP |
| 1044 | 1383263.14 | 1698 | 1757 | forward 3 | TM |
| 1044 | 1383263.14 | 107 | 160 | forward 2 | TM |
| 1044 | 1383263.14 | 83 | 163 | forward 2 | SP |
| 1044 | 1383263.14 | 1353 | 1424 | forward 3 | SP |
| 1044 | 1383263.14 | 107 | 178 | forward 2 | SP |
| 1044 | 1383263.14 | 1696 | 1755 | forward 1 | TM |
| 1044 | 1383263.14 | 113 | 172 | forward 2 | TM |
| 1044 | 1383263.14 | 107 | 163 | forward 2 | SP |
| 1045 | 406707.2 | 423 | 491 | forward 3 | SP |
| 1045 | 406707.2 | 375 | 434 | forward 3 | TM |
| 1046 | 406707.1 | 277 | 345 | forward 1 | SP |
| 1046 | 406707.1 | 230 | 289 | forward 2 | SP |
| 1046 | 406707.1 | 230 | 292 | forward 2 | SP |
| 1046 | 406707.1 | 229 | 288 | forward 1 | TM |
| 1050 | 335568.1 | 959 | 1039 | forward 2 | TM |
| 1050 | 335568.1 | 209 | 268 | forward 2 | SP |
| 1050 | 335568.1 | 1937 | 1999 | forward 2 | SP |
| 1050 | 335568.1 | 209 | 262 | forward 2 | SP |
| 1050 | 335568.1 | 977 | 1030 | forward 2 | TM |
| 1050 | 335568.1 | 956 | 1030 | forward 2 | TM |
| 1050 | 335568.1 | 977 | 1033 | forward 2 | TM |
| 1050 | 335568.1 | 956 | 1027 | forward 2 | TM |
| 1050 | 335568.1 | 974 | 1036 | forward 2 | TM |
| 1052 | 272273.1 | 851 | 910 | forward 2 | TM |
| 1053 | 399133.9 | 2698 | 2766 | forward 1 | SP |
| 1053 | 399133.9 | 2698 | 2757 | forward 1 | SP |
| 1053 | 399133.9 | 3717 | 3779 | forward 3 | TM |
| 1053 | 399133.9 | 714 | 803 | forward 3 | SP |
| 1054 | 246727.11 | 209 | 262 | forward 2 | TM |
| 1055 | 246727.17 | 2454 | 2537 | forward 3 | SP |
| 1056 | 230367.2 | 533 | 598 | forward 2 | SP |
| 1056 | 230367.2 | 155 | 217 | forward 2 | TM |
| 1056 | 230367.2 | 533 | 592 | forward 2 | SP |
| 1056 | 230367.2 | 2070 | 2126 | forward 3 | TM |
| 1056 | 230367.2 | 1341 | 1412 | forward 3 | SP |
| 1057 | 1383039.18 | 335 | 394 | forward 2 | SP |
| 1059 | 27704.2 | 6 | 77 | forward 3 | TM |
| 1060 | 346900.1 | 122 | 196 | forward 2 | TM |
| 1060 | 346900.1 | 158 | 211 | forward 2 | SP |
| 1060 | 346900.1 | 6 | 62 | forward 3 | TM |
| 1060 | 346900.1 | 146 | 196 | forward 2 | TM |
| 1060 | 346900.1 | 140 | 196 | forward 2 | TM |
| 1062 | 411357.1 | 611 | 676 | forward 2 | SP |
| 1062 | 411357.1 | 115 | 177 | forward 1 | SP |
| 1064 | 210133.1 | 1788 | 1847 | forward 3 | SP |
| 1068 | 206344.1 | 694 | 744 | forward 1 | TM |
| 1072 | 1092387.12 | 810 | 881 | forward 3 | SP |
| 1072 | 1092387.12 | 763 | 825 | forward 1 | SP |
| 1073 | 1092387.11 | 770 | 829 | forward 2 | SP |
| 1073 | 1092387.11 | 788 | 841 | forward 2 | TM |
| 1073 | 1092387.11 | 931 | 993 | forward 1 | TM |
| 1074 | 366463.1 | 169 | 231 | forward 1 | TM |
| 1079 | 1089210.1 | 954 | 1022 | forward 3 | SP |
| 1079 | 1089210.1 | 915 | 977 | forward 3 | TM |
| 1080 | 444619.9 | 265 | 339 | forward 1 | SP |
| 1081 | 312986.1 | 272 | 346 | forward 2 | SP |
| 1082 | 462057.1 | 3021 | 3074 | forward 3 | TM |
| 1082 | 462057.1 | 3018 | 3098 | forward 3 | TM |
| 1082 | 462057.1 | 2634 | 2687 | forward 3 | TM |
| 1082 | 462057.1 | 4415 | 4471 | forward 2 | TM |
| 1082 | 462057.1 | 4460 | 4534 | forward 2 | TM |
| 1082 | 462057.1 | 3000 | 3068 | forward 3 | SP |
| 1082 | 462057.1 | 2994 | 3056 | forward 3 | TM |
| 1082 | 462057.1 | 2304 | 2366 | forward 3 | SP |
| 1082 | 462057.1 | 1890 | 1943 | forward 3 | SP |
| 1082 | 462057.1 | 3045 | 3104 | forward 3 | TM |
| 1082 | 462057.1 | 3051 | 3119 | forward 3 | TM |
| 1082 | 462057.1 | 2991 | 3062 | forward 3 | TM |
| 1083 | 197902.12 | 3358 | 3411 | forward 1 | TM |
| 1083 | 197902.12 | 2306 | 2371 | forward 2 | TM |
| 1083 | 197902.12 | 2663 | 2737 | forward 2 | TM |
| 1083 | 197902.12 | 2 | 79 | forward 2 | SP |
| 1083 | 197902.12 | 2315 | 2371 | forward 2 | TM |
| 1083 | 197902.12 | 2 | 64 | forward 2 | SP |
| 1083 | 197902.12 | 1515 | 1589 | forward 3 | SP |
| 1083 | 197902.12 | 2675 | 2734 | forward 2 | TM |
| 1083 | 197902.12 | 2 | 55 | forward 2 | SP |
| 1083 | 197902.12 | 2 | 55 | forward 2 | SP |
| 1083 | 197902.12 | 2 | 70 | forward 2 | SP |
| 1083 | 197902.12 | 2 | 73 | forward 2 | SP |
| 1084 | 997394.4 | 2190 | 2273 | forward 3 | SP |
| 1087 | 8198.1 | 200 | 271 | forward 2 | TM |
| 1087 | 8198.1 | 1530 | 1592 | forward 3 | SP |
| 1087 | 8198.1 | 1515 | 1589 | forward 3 | SP |
| 1089 | 994430.16 | 19 | 84 | forward 1 | SP |
| 1089 | 994430.16 | 40 | 84 | forward 1 | SP |
| 1089 | 994430.16 | 37 | 90 | forward 1 | SP |
| 1089 | 994430.16 | 10 | 66 | forward 1 | TM |
| 1089 | 994430.16 | 1 | 90 | forward 1 | SP |
| 1089 | 994430.16 | 25 | 84 | forward 1 | SP |
| 1091 | 221042.1 | 930 | 1016 | forward 3 | SP |
| 1092 | 408398.1 | 143 | 196 | forward 2 | SP |
| 1093 | 985369.1 | 1016 | 1078 | forward 2 | TM |
| 1093 | 985369.1 | 1046 | 1105 | forward 2 | TM |
| 1095 | 58804.1 | 543 | 593 | forward 3 | TM |
| 1098 | 197159.1 | 1041 | 1091 | forward 3 | TM |
| 1098 | 197159.1 | 83 | 139 | forward 2 | TM |
| 1098 | 197159.1 | 2946 | 3020 | forward 3 | SP |
| 1098 | 197159.1 | 3156 | 3218 | forward 3 | TM |
| 1098 | 197159.1 | 2958 | 3017 | forward 3 | SP |
| 1099 | 369928.1 | 757 | 819 | forward 1 | TM |
| 1100 | 413466.6 | 398 | 451 | forward 2 | TM |
| 1100 | 413466.6 | 1811 | 1885 | forward 2 | TM |
| 1100 | 413466.6 | 1808 | 1861 | forward 2 | TM |
| 1100 | 413466.6 | 1306 | 1395 | forward 1 | SP |
| 1100 | 413466.6 | 335 | 409 | forward 2 | SP |
| 1100 | 413466.6 | 335 | 421 | forward 2 | SP |
| 1100 | 413466.6 | 1318 | 1389 | forward 1 | SP |
| 1101 | 397295.1 | 46 | 102 | forward 1 | TM |
| 1102 | 1330139.5 | 953 | 1036 | forward 2 | SP |
| 1103 | 977951.1 | 481 | 549 | forward 1 | TM |
| 1104 | 347316.1 | 1351 | 1419 | forward 1 | SP |
| 1104 | 347316.1 | 4855 | 4908 | forward 1 | TM |
| 1104 | 347316.1 | 3980 | 4036 | forward 2 | SP |
| 1104 | 347316.1 | 3991 | 4062 | forward 1 | SP |
| 1104 | 347316.1 | 900 | 953 | forward 3 | SP |

TABLE 4-continued

| SEQ ID NO | Template ID | Start | Stop | Frame | Hit Type |
|---|---|---|---|---|---|
| 1104 | 347316.1 | 1231 | 1296 | forward 1 | SP |
| 1104 | 347316.1 | 4684 | 4743 | forward 1 | TM |
| 1104 | 347316.1 | 3970 | 4032 | forward 1 | TM |
| 1104 | 347316.1 | 2611 | 2688 | forward 1 | TM |
| 1104 | 347316.1 | 1351 | 1404 | forward 1 | SP |
| 1104 | 347316.1 | 3718 | 3789 | forward 1 | TM |
| 1104 | 347316.1 | 4966 | 5019 | forward 1 | TM |
| 1104 | 347316.1 | 1351 | 1422 | forward 1 | SP |
| 1104 | 347316.1 | 4342 | 4404 | forward 1 | TM |
| 1104 | 347316.1 | 4336 | 4407 | forward 1 | TM |
| 1104 | 347316.1 | 4792 | 4848 | forward 1 | TM |
| 1104 | 347316.1 | 4669 | 4737 | forward 1 | TM |
| 1104 | 347316.1 | 2905 | 2958 | forward 1 | SP |
| 1104 | 347316.1 | 4009 | 4077 | forward 1 | SP |
| 1104 | 347316.1 | 2260 | 2322 | forward 1 | TM |
| 1104 | 347316.1 | 4585 | 4644 | forward 1 | TM |
| 1104 | 347316.1 | 1363 | 1425 | forward 1 | TM |
| 1104 | 347316.1 | 2386 | 2442 | forward 1 | TM |
| 1104 | 347316.1 | 2647 | 2700 | forward 1 | TM |
| 1104 | 347316.1 | 2905 | 2970 | forward 1 | SP |
| 1104 | 347316.1 | 513 | 590 | forward 3 | TM |
| 1104 | 347316.1 | 4009 | 4071 | forward 1 | SP |
| 1104 | 347316.1 | 4930 | 5001 | forward 1 | TM |
| 1104 | 347316.1 | 2905 | 2967 | forward 1 | SP |
| 1104 | 347316.1 | 4960 | 5037 | forward 1 | TM |
| 1104 | 347316.1 | 895 | 963 | forward 1 | SP |
| 1104 | 347316.1 | 4948 | 5028 | forward 1 | SP |
| 1104 | 347316.1 | 2632 | 2694 | forward 1 | TM |
| 1104 | 347316.1 | 900 | 962 | forward 3 | SP |
| 1104 | 347316.1 | 2899 | 2964 | forward 1 | TM |
| 1104 | 347316.1 | 3997 | 4050 | forward 1 | TM |
| 1104 | 347316.1 | 4339 | 4392 | forward 1 | TM |
| 1104 | 347316.1 | 4951 | 5013 | forward 1 | SP |
| 1104 | 347316.1 | 2611 | 2679 | forward 1 | TM |
| 1104 | 347316.1 | 2878 | 2949 | forward 1 | TM |
| 1104 | 347316.1 | 1351 | 1398 | forward 1 | TM |
| 1104 | 347316.1 | 2896 | 2970 | forward 1 | SP |
| 1104 | 347316.1 | 4975 | 5043 | forward 1 | TM |
| 1104 | 347316.1 | 4009 | 4062 | forward 1 | SP |
| 1104 | 347316.1 | 4753 | 4815 | forward 1 | TM |
| 1104 | 347316.1 | 2896 | 2985 | forward 1 | SP |
| 1104 | 347316.1 | 1366 | 1431 | forward 1 | TM |
| 1104 | 347316.1 | 1351 | 1410 | forward 1 | TM |
| 1104 | 347316.1 | 1354 | 1437 | forward 1 | TM |
| 1104 | 347316.1 | 4948 | 5013 | forward 1 | SP |
| 1104 | 347316.1 | 4015 | 4074 | forward 1 | TM |
| 1104 | 347316.1 | 786 | 839 | forward 3 | TM |
| 1104 | 347316.1 | 4753 | 4821 | forward 1 | TM |
| 1104 | 347316.1 | 2878 | 2940 | forward 1 | TM |
| 1104 | 347316.1 | 4348 | 4407 | forward 1 | TM |
| 1104 | 347316.1 | 4762 | 4818 | forward 1 | TM |
| 1104 | 347316.1 | 2878 | 2931 | forward 1 | TM |
| 1104 | 347316.1 | 4948 | 5022 | forward 1 | SP |
| 1104 | 347316.1 | 897 | 953 | forward 3 | TM |
| 1104 | 347316.1 | 2890 | 2952 | forward 1 | TM |
| 1104 | 347316.1 | 4975 | 5034 | forward 1 | TM |
| 1104 | 347316.1 | 2656 | 2712 | forward 1 | TM |
| 1104 | 347316.1 | 4333 | 4404 | forward 1 | TM |
| 1104 | 347316.1 | 1348 | 1419 | forward 1 | TM |
| 1105 | 150288.3 | 836 | 901 | forward 2 | SP |
| 1105 | 150288.3 | 337 | 384 | forward 1 | SP |
| 1105 | 150288.3 | 331 | 387 | forward 1 | TM |
| 1105 | 150288.3 | 325 | 378 | forward 1 | TM |
| 1105 | 150288.3 | 319 | 378 | forward 1 | TM |
| 1107 | 372647.1 | 63 | 134 | forward 3 | TM |
| 1107 | 372647.1 | 81 | 143 | forward 3 | SP |
| 1107 | 372647.1 | 66 | 113 | forward 3 | TM |
| 1107 | 372647.1 | 66 | 128 | forward 3 | TM |
| 1108 | 137710.1 | 648 | 710 | forward 3 | TM |
| 1108 | 137710.1 | 654 | 710 | forward 3 | TM |
| 1109 | 407644.1 | 658 | 717 | forward 1 | TM |
| 1109 | 407644.1 | 910 | 984 | forward 1 | SP |
| 1109 | 407644.1 | 631 | 702 | forward 1 | SP |
| 1109 | 407644.1 | 909 | 968 | forward 3 | SP |
| 1109 | 407644.1 | 3262 | 3330 | forward 1 | SP |
| 1109 | 407644.1 | 884 | 958 | forward 2 | SP |
| 1109 | 407644.1 | 3262 | 3342 | forward 1 | SP |
| 1109 | 407644.1 | 3235 | 3312 | forward 1 | TM |
| 1109 | 407644.1 | 3262 | 3351 | forward 1 | SP |
| 1110 | 373516.1 | 364 | 435 | forward 1 | SP |
| 1111 | 241762.23 | 1634 | 1717 | forward 2 | SP |
| 1112 | 1040914.1 | 434 | 496 | forward 2 | TM |
| 1112 | 1040914.1 | 452 | 511 | forward 2 | SP |
| 1113 | 358492.1 | 125 | 205 | forward 2 | SP |
| 1117 | 168955.1 | 615 | 698 | forward 3 | TM |
| 1120 | 403994.5 | 417 | 485 | forward 3 | TM |
| 1120 | 403994.5 | 396 | 464 | forward 3 | TM |
| 1121 | 336726.1 | 666 | 737 | forward 3 | TM |
| 1122 | 337250.1 | 1179 | 1241 | forward 3 | TM |
| 1123 | 410781.1 | 1182 | 1235 | forward 3 | TM |
| 1126 | 209279.1 | 4636 | 4707 | forward 1 | SP |
| 1126 | 209279.1 | 2203 | 2274 | forward 1 | TM |
| 1126 | 209279.1 | 2423 | 2476 | forward 2 | SP |
| 1126 | 209279.1 | 3185 | 3238 | forward 2 | SP |
| 1126 | 209279.1 | 3185 | 3253 | forward 2 | SP |
| 1126 | 209279.1 | 2423 | 2491 | forward 2 | SP |
| 1126 | 209279.1 | 2212 | 2259 | forward 1 | TM |
| 1126 | 209279.1 | 2804 | 2878 | forward 2 | SP |
| 1126 | 209279.1 | 2813 | 2857 | forward 2 | SP |
| 1126 | 209279.1 | 3194 | 3238 | forward 2 | SP |
| 1126 | 209279.1 | 2432 | 2476 | forward 2 | SP |
| 1126 | 209279.1 | 2804 | 2857 | forward 2 | SP |
| 1126 | 209279.1 | 2423 | 2482 | forward 2 | SP |
| 1126 | 209279.1 | 3185 | 3244 | forward 2 | SP |
| 1126 | 209279.1 | 2804 | 2863 | forward 2 | SP |
| 1126 | 209279.1 | 2212 | 2271 | forward 1 | TM |
| 1126 | 209279.1 | 3185 | 3253 | forward 2 | SP |
| 1126 | 209279.1 | 2423 | 2491 | forward 2 | SP |
| 1126 | 209279.1 | 2804 | 2872 | forward 2 | SP |
| 1128 | 480630.21 | 269 | 325 | forward 2 | TM |
| 1133 | 140122.22 | 1009 | 1065 | forward 1 | TM |
| 1133 | 140122.22 | 1802 | 1852 | forward 2 | TM |
| 1133 | 140122.22 | 2868 | 2921 | forward 3 | TM |
| 1133 | 140122.22 | 3511 | 3564 | forward 1 | TM |
| 1133 | 140122.22 | 1766 | 1822 | forward 2 | TM |
| 1133 | 140122.22 | 2865 | 2921 | forward 3 | TM |
| 1133 | 140122.22 | 553 | 633 | forward 1 | TM |
| 1133 | 140122.22 | 3487 | 3543 | forward 1 | TM |
| 1134 | 131931.1 | 253 | 303 | forward 1 | TM |
| 1139 | 887619.26 | 728 | 784 | forward 2 | TM |
| 1140 | 980953.1 | 348 | 410 | forward 3 | TM |
| 1140 | 980953.1 | 216 | 275 | forward 3 | TM |
| 1140 | 980953.1 | 337 | 411 | forward 1 | TM |
| 1140 | 980953.1 | 313 | 369 | forward 1 | TM |
| 1140 | 980953.1 | 336 | 401 | forward 3 | TM |
| 1140 | 980953.1 | 306 | 386 | forward 3 | TM |
| 1140 | 980953.1 | 339 | 410 | forward 3 | TM |
| 1140 | 980953.1 | 348 | 401 | forward 3 | TM |
| 1140 | 980953.1 | 339 | 398 | forward 3 | TM |

TABLE 5

| SEQ ID NO | Template ID | Tissue Distribution |
|---|---|---|
| 1 | 230040.1 | Embryonic Structures - 41%, Liver - 20%, Nervous System - 11% |
| 2 | 175138.1 | Hemic and Immune System - 60%, Digestive System - 40% |
| 4 | 1863336CD1 | |
| 5 | 343861.16 | widely distributed |
| 7 | 3170236CD1 | |
| 8 | 259805.54 | Embryonic Structures - 11%, Endocrine System - 10% |
| 10 | 1460258CD1 | |
| 11 | 1016903.1 | Musculoskeletal System - 28%, Cardiovascular System - 14%, Respiratory System - 11% |
| 12 | 65385.7 | Sense Organs- 14%, Urinary Tract- 11% |
| 13 | 3714.1 | Male Genitalia - 67%, Nervous System - 33% |

TABLE 5-continued

| SEQ ID NO | Template ID | Tissue Distribution |
|---|---|---|
| 15 | 1720920CD1 | |
| 16 | 256009.48 | Embryonic Structures - 20%, Liver - 13%, Female Genitalia - 12% |
| 17 | 1055233.1 | Hemic and Immune System - 100% |
| 19 | 2114865CD1 | |
| 20 | 1383740.1 | Liver - 50%, Germ Cells - 36%, Hemic and Immune System - 12% |
| 22 | 2700132CD1 | |
| 23 | 231621.1 | Unclassified/Mixed - 29%, Urinary Tract - 25%, Exocrine Glands - |
| 24 | 216485.1 | Connective Tissue - 30%, Exocrine Glands - 17%, Urinary Tract - 17%, Hemic and Immune System - 17% |
| 25 | 406004.2 | Urinary Tract- 100% |
| 26 | 1399930.1 | Respiratory System - 18%, Pancreas - 16%, Endocrine System - 16% |
| 27 | 414171.33 | Skin - 19%, Liver- 18%, Nervous System - 12% |
| 28 | 230895.1 | Nervous System - 41%, Respiratory System - 29%, Female Genitalia - 29% |
| 29 | 22827.1 | Urinary Tract - 27%, Musculoskeletal System - 23%, Digestive System - 15% |
| 30 | 346663.6 | Unclassified/Mixed - 62%, Male Genitalia - 15%, Digestive System - |
| 31 | 96422.1 | Male Genitalia - 100% |
| 32 | 405833.1 | Germ Cells - 57%, Male Genitalia - 43% |
| 33 | 995839.2 | Liver - 25%, Musculoskeletal System - 13%, Cardiovascular System - 11% |
| 35 | 2517374CD1 | |
| 37 | 1255456CD1 | |
| 38 | 3084.1 | Cardiovascular System - 100% |
| 39 | 302123.12 | Hemic and Immune System - 100% |
| 41 | 533825CD1 | |
| 42 | 220845.2 | Hemic and Immune System - 100% |
| 43 | 985475.8 | Connective Tissue - 16% |
| 44 | 198309.7 | Liver - 69%, Respiratory System - 23% |
| 45 | 1382869.18 | widely distributed |
| 46 | 1382869.1 | widely distributed |
| 47 | 352049.1 | Liver - 69%, Male Genitalia - 15% |
| 48 | 215990.2 | Embryonic Structures - 10% |
| 49 | 428335.59 | Pancreas - 14% |
| 51 | 1561192CD1 | |
| 52 | 1330151.46 | Musculoskeletal System - 12%, Stomatognathic System - 12% |
| 53 | 1330151.49 | Musculoskeletal System - 14%, Stomatognathic System - 12% |
| 54 | 404028.1 | Pancreas - 35%, Exocrine Glands - 15%, Unclassified/Mixed - 15% |
| 55 | 996427.2 | Hemic and Immune System - 18%, Exocrine Glands - 12% |
| 56 | 21971.1 | Urinary Tract - 88%, Respiratory System - 12% |
| 57 | 215205.1 | Endocrine System - 36%, Urinary Tract - 36%, Respiratory System - 27% |
| 58 | 400650.3 | Exocrine Glands - 24%, Unclassified/Mixed - 24%, Connective Tissue - 21% |
| 59 | 344524.1 | Liver - 16%, Exocrine Glands - 11%, Unclassified/Mixed - 11% |
| 60 | 196709.1 | Germ Cells - 28%, Unclassified/Mixed - 22%, Embryonic Structures - 10% |
| 61 | 37502.4 | Sense Organs - 43%, Nervous System - 14%, Connective Tissue - |
| 62 | 235687.5 | Germ Cells - 45%, Skin - 24%, Unclassified/Mixed - 14% |
| 64 | 085596CD1 | |
| 65 | 234811.3 | Liver - 24%, Germ Cells - 11% |
| 67 | 3393396CD1 | |
| 68 | 978439.4 | Unclassified/Mixed - 13% |
| 69 | 11390.1 | Hemic and Immune System - 100% |
| 70 | 1382924.42 | Pancreas - 21%, Exocrine Glands - 19%, Cardiovascular System - |
| 72 | 1256895CD1 | |
| 73 | 11115.1 | Hemic and Immune System - 100% |
| 74 | 291267.1 | Hemic and Immune System - 43%, Skin - 21% |
| 76 | 3125723CD1 | |
| 77 | 980593.1 | Embryonic Structures - 13%, Sense Organs - 12% |
| 78 | 980593.6 | Sense Organs - 15%, Unclassified/Mixed - 12%, Embryonic Structures - 10% |
| 79 | 410739.1 | Nervous System - 100% |
| 80 | 405773.2 | Respiratory System - 28%, Liver - 19%, Urinary Tract - 19% |
| 81 | 210871.1 | Digestive System - 67%, Hemic and Immune System - 33% |
| 82 | 20265.2 | Respiratory System - 100% |
| 83 | 39840.1 | Connective Tissue - 55%, Embryonic Structures - 12%, Unclassified/Mixed - 11% |
| 85 | 088564CD1 | |
| 86 | 28889.1 | Hemic and Immune System - 47%, Digestive System - 27%, Endocrine System - 27% |
| 87 | 410611.1 | Hemic and Immune System - 100% |
| 88 | 212533.1 | Sense Organs - 58%, Hemic and Immune System - 13% |
| 89 | 24081.12 | Urinary Tract - 23%, Digestive System - 13% |
| 90 | 983961.1 | Skin - 30%, Nervous System - 17%, Exocrine Glands - 17% |
| 91 | 1383290.2 | widely distributed |
| 92 | 337221.11 | Germ Cells - 16%, Pancreas - 11% |
| 93 | 290344.1 | Nervous System - 36%, Embryonic Structures - 23%, Musculoskeletal System - 15% |
| 94 | 290344.3 | Embryonic Structures - 35%, Connective Tissue - 27%, Nervous System - 23% |
| 95 | 222714.1 | Embryonic Structures - 64%, Endocrine System - 29% |
| 96 | 2230.1 | Liver - 47%, Cardiovascular System - 21%, Endocrine System - 21% |
| 97 | 34424.1 | Cardiovascular System - 62%, Endocrine System - 31% |
| 98 | 153237.1 | Endocrine System - 57%, Male Genitalia - 29%, Nervous System - |
| 99 | 272843.14 | Pancreas - 11% |
| 100 | 234729.3 | Embryonic Structures- 14%, Connective Tissue - 10% |
| 101 | 349647.1 | Urinary Tract - 31%, Unclassified/Mixed - 18%, Respiratory System - 11% |
| 102 | 236457.1 | Nervous System - 33%, Endocrine System - 22%, Urinary Tract - 22%, Digestive System - 22% |
| 103 | 230193.1 | Liver - 19%, Nervous System - 15%, Musculoskeletal System - 14% |
| 104 | 213429.1 | Exocrine Glands - 67%, Female Genitalia - 33% |
| 105 | 5124.22 | Exocrine Glands - 43%, Urinary Tract - 4%, Digestive System - 14% |
| 106 | 88974.2 | Respiratory System - 33%, Hemic and Immune System - 33%, Female Genitalia - 22% |
| 107 | 903909.1 | Nervous System - 67% |
| 108 | 196981.1 | Nervous System - 80%, Digestive System - 20% |
| 109 | 337888.3 | Nervous System - 43%, Germ Cells - 32%, Endocrine System - 16% |
| 110 | 795.1 | Nervous System - 100% |
| 112 | 3070147CD1 | |
| 113 | 20525.1 | Female Genitalia - 100% |
| 114 | 1382924.38 | widely distributed |
| 116 | 4349106CD1 | |
| 117 | 247185.1 | Musculoskeletal System - 40%, Respiratory System - 33%, Male Genitalia - 13% |
| 118 | 197587.3 | Sense Organs - 53%, Nervous System - 12%, Cardiovascular System - 11% |
| 119 | 403872.1 | Nervous System - 30%, Embryonic Structures - 18%, Unclassified/Mixed - 16% |

TABLE 5-continued

| SEQ ID NO | Template ID | Tissue Distribution |
|---|---|---|
| 120 | 900993.1 | Urinary Tract - 29%, Female Genitalia - 38%, Male Genitalia - 11%, Exocrine Glands - 11%, Endocrine System - 11%, Hemic and Immune System - 11% |
| 121 | 228511.1 | Unclassified/Mixed - 18%, Germ Cells - 13%, Male Genitalia - 12% |
| 122 | 406975.2 | Urinary Tract - 24%, Respiratory System - 14%, Skin - 11% |
| 123 | 200171.17 | Musculoskeletal System - 29%, Respiratory System - 24%, Endocrine System - 19% |
| 124 | 291155.1 | Urinary Tract - 67%, Nervous System - 33% |
| 125 | 1383047.1 | Unclassified/Mixed - 35%, Sense Organs - 22% |
| 127 | 3230770CD1 | |
| 128 | 481453.1 | Male Genitalia - 67%, Nervous System - 33% |
| 129 | 216141.1 | Male Genitalia - 80%, Nervous System - 20% |
| 130 | 158318.1 | Cardiovascular System - 40%, Respiratory System - 30%, Male Genitalia - 20% |
| 131 | 408751.3 | Nervous System - 43%, Sense Organs - 31% |
| 132 | 998310.1 | Nervous System - 100% |
| 133 | 1097471.1 | Unclassified/Mixed - 34%, Nervous System - 13% |
| 134 | 983843.2 | Musculoskeletal System - 55%, Respiratory System - 45% |
| 135 | 983843.1 | Female Genitalia - 44%, Cardiovascular System - 30%, Respiratory System - 19% |
| 136 | 985607.8 | Respiratory System - 12% |
| 137 | 152298.2 | Digestive System - 50%, Respiratory System - 38%, Hemic and Immune System - 13% |
| 138 | 246336.2 | Germ Cells - 24%, Female Genitalia - 17%, Hemic and Immune System - 11% |
| 139 | 246336.18 | Sense Organs - 20%, Unclassified/Mixed - 14%, Stomatognathic System - 12% |
| 140 | 405126.1 | Digestive System - 100% |
| 141 | 253855.2 | Liver - 20%, Embryonic Structures - 10% |
| 142 | 337187.1 | Nervous System - 16%, Skin - 14%, Germ Cells - 13% |
| 144 | 932244CD1 | |
| 145 | 160952.1 | Pancreas - 53%, Exocrine Glands - 47% |
| 146 | 13343.1 | Endocrine System - 33%, Urinary Tract - 33%, Nervous System - 17%, Digestive System - 17% |
| 147 | 399488.4 | Urinary Tract - 49%, Liver - 36% |
| 148 | 399488.5 | Urinary Tract - 77%, Liver - 16% |
| 149 | 28048.1 | Exocrine Glands - 100% |
| 150 | 237622.11 | Cardiovascular System - 25%, Exocrine Glands - 25%, Respiratory System - 19% |
| 151 | 237622.6 | widely distributed |
| 152 | 26612.1 | Exocrine Glands - 67%, Endocrine System - 33% |
| 153 | 413806.9 | Unclassified/Mixed - 16% |
| 154 | 162569.1 | Embryonic Structures - 83%, Urinary Tract - 17% |
| 155 | 334116.1 | Germ Cells - 14%, Unclassified/Mixed - 14%, Skin - 11% |
| 156 | 396837.1 | Urinary Tract - 35%, Skin 22%, Embryonic Structures - 14% |
| 157 | 406507.1 | Sense Organs - 68%, Endocrine System - 12%, Exocrine Glands - |
| 158 | 407612.1 | Unclassified/Mixed - 21%, Musculoskeletal System - 13%, Germ Cells - 11% |
| 159 | 399501.1 | Embryonic Structures - 39%, Exocrine Glands - 35%, Endocrine System - 17% |
| 161 | 1004517CD1 | |
| 162 | 199601.12 | Hemic and Immune System - 67% |
| 163 | 232946.1 | Skin - 17% |
| 165 | 988491CD1 | |
| 166 | 199882.12 | Respiratory System - 75%, Nervous System - 25% |
| 168 | 1674368CD1 | |
| 169 | 115268.8 | Endocrine System - 45%, Exocrine Glands - 20%, Respiratory System - 13%, Nervous System - 13% |
| 170 | 464689.54 | Male Genitalia - 18%, Nervous System - 13% |
| 171 | 222181.1 | Unclassified/Mixed - 27%, Nervous System - 21%, Exocrine Glands - 13% |
| 173 | 2951538CD1 | |
| 174 | 1087445.1 | Unclassified/Mixed - 18%, Nervous System - 13%, Respiratory System - 10% |
| 175 | 1079625.3 | Germ Cells - 22%, Unclassified/Mixed - 21%, Endocrine System - |
| 177 | 1275616CD1 | |
| 178 | 228046.5 | Stomatognathic System - 14% |
| 179 | 1225513.1 | Musculoskeletal System - 21%, Liver - 19% |
| 180 | 203438.2 | Embryonic Structures - 100% |
| 181 | 232849.13 | Connective Tissue - 34%, Embryonic Structures - 13%, Liver - 13% |
| 182 | 19598.1 | Embryonic Structures - 75%, Hemic and Immune System - 25% |
| 183 | 411148.3 | Embryonic Structures - 12% |
| 184 | 444619.13 | Liver - 42%, Endocrine System - 11% |
| 185 | 1383714.1 | Female Genitalia - 50%, Digestive System - 50% |
| 187 | 1273641CD1 | |
| 188 | 403717.1 | Unclassified/Mixed - 37%, Embryonic Structures - 20%, Cardiovascular System - 17% |
| 189 | 332165.8 | Unclassified/Mixed - 24%, Germ Cells - 12%, Connective Tissue - |
| 190 | 1098877.1 | Stomatognathic System - 10% |
| 191 | 251867.2 | Embryonic Structures - 51%, Musculoskeletal System - 16%, Endocrine System - 11%, Urinary Tract - 11% |
| 192 | 5597.1 | Stomatognathic System - 96% |
| 193 | 235356.1 | Stomatognathic System - 66%, Liver - 17% |
| 194 | 47593.1 | Stomatognathic System - 100% |
| 195 | 995887.12 | Sense Organs- 25%, Female Genitalia - 14%, Nervous System - |
| 196 | 245687.1 | Sense Organs - 30%, Unclassified/Mixed - 29%, Pancreas - 15% |
| 198 | 1571349CD1 | |
| 199 | 336735.1 | Musculoskeletal System - 67%, Digestive System - 22%, Hemic and Immune System - 11% |
| 200 | 40322.1 | Hemic and Immune System - 15% |
| 201 | 205542.2 | Germ Cells - 30%, Female Genitalia - 21%, Sense Organs - 15% |
| 203 | 1867417CD1 | |
| 204 | 402521.1 | Nervous System - 100% |
| 205 | 219537.2 | Sense Organs - 96% |
| 206 | 219537.1 | Hemic and Immune System - 50%, Male Genitalia - 33%, Nervous System - 17% |
| 207 | 1041138.7 | widely distributed |
| 208 | 49272.1 | Nervous System - 100% |
| 209 | 221433.2 | Respiratory System - 21%, Endocrine System - 18%, Liver - 18% |
| 210 | 232386.18 | Unclassified/Mixed - 27%, Liver - 15%, Digestive System - 12% |
| 212 | 2598244CD1 | |
| 214 | 2173757CD1 | |
| 216 | 1405844CD1 | |
| 217 | 1143377.5 | Sense Organs - 21%, Connective Tissue - 11%, Nervous System - |
| 218 | 235147.1 | Cardiovascular System - 13%, Connective Tissue - 12% |
| 219 | 235147.2 | Cardiovascular System - 18%, Connective Tissue - 15%, Unclassified/Mixed - 13% |
| 220 | 1099294.6 | Stomatognathic System - 15% |
| 221 | 330927.1 | Unclassified/Mixed - 28%, Male Genitalia - 12%, Exocrine Glands - |
| 222 | 50695.1 | Respiratory System - 100% |
| 223 | 241234.1 | Pancreas - 59%, Hemic and Immune System - 20%, Musculoskeletal System - 13% |

TABLE 5-continued

| SEQ ID NO | Template ID | Tissue Distribution |
|---|---|---|
| 224 | 282397.77 | Embryonic Structures - 11% |
| 225 | 984009.2 | Embryonic Structures - 31%, Connective Tissue - 24% |
| 226 | 138709.5 | widely distributed |
| 227 | 998926.1 | Germ Cells - 16%, Urinary Tract - 11%, Digestive System - 10% |
| 229 | 1448817CD1 | |
| 230 | 332521.1 | Embryonic Structures - 18%, Unclassified/Mixed - 16%, Musculoskeletal System - 12% |
| 231 | 245136.4 | Female Genitalia - 33%, Male Genitalia - 18% |
| 232 | 237485.3 | Unclassified/Mixed - 31%, Liver - 20% |
| 233 | 350851.2 | Exocrine Glands - 80%, Nervous System - 20% |
| 234 | 403794.3 | Urinary Tract - 44%, Respiratory System - 33%, Nervous System - |
| 235 | 227489.1 | Female Genitalia - 39%, Unclassified/Mixed - 35%, Cardiovascular System - 17% |
| 236 | 268110.1 | Male Genitalia - 100% |
| 237 | 268244.1 | Male Genitalia - 100% |
| 238 | 268253.1 | Male Genitalia - 100% |
| 239 | 270049.1 | Exocrine Glands - 67%, Male Genitalia - 33% |
| 240 | 997142.1 | Unclassified/Mixed - 27%, Musculoskeletal System - 20%, Male Genitalia - 13%, Cardiovascular System - 13% |
| 241 | 997080.1 | Urinary Tract - 49%, Digestive System - 29%, Liver - 13% |
| 242 | 243369.1 | Liver - 60%, Digestive System - 40% |
| 243 | 379571.7 | Unclassified/Mixed - 15% |
| 244 | 322303.15 | Embryonic Structures - 56%, Sense Organs - 12%, Unclassified/Mixed - 11% |
| 245 | 232935.2 | Nervous System - 21%, Endocrine System - 12%, Unclassified/Mixed - 12% |
| 247 | 1445507CD1 | |
| 248 | 69812.3 | Urinary Tract - 15%, Respiratory System - 12% |
| 249 | 444648.12 | Liver - 23%, Male Genitalia - 12% |
| 250 | 25194.1 | Pancreas - 38%, Nervous System - 21%, Exocrine Glands - 17%, Hemic and Immune System - 17% |
| 252 | 1518310CD1 | |
| 253 | 241335.1 | Connective Tissue 15%, Embryonic Structures - 12% |
| 254 | 22651.1 | Embryonic Structures - 56%, Unclassified/Mixed - 24%, Urinary Tract - 21% |
| 255 | 25911.1 | Exocrine Glands - 34%, Male Genitalia - 15%, Nervous System - 11%, Unclassified/Mixed - 11% |
| 256 | 336470.1 | Embryonic Structures - 39%, Unclassified/Mixed - 35%, Hemic and Immune System - 17% |
| 257 | 978673.2 | Musculoskeletal System - 19%, Urinary Tract - 11% |
| 258 | 54242.1 | Musculoskeletal System - 55%, Hemic and Immune System - 27%, Female Genitalia - 18% |
| 260 | 1823159CD1 | |
| 261 | 20602.1 | Female Genitalia - 88%, Hemic and Immune System - 13% |
| 262 | 1090531.28 | Connective Tissue - 32%, Liver 17%, Unclassified/Mixed - 16% |
| 263 | 399872.1 | Embryonic Structures - 41%, Respiratory System 23%, Male Genitalia - 18% |
| 264 | 229176.4 | Nervous System - 46%, Exocrine Glands - 31%, Female Genitalia - |
| 265 | 229176.5 | widely distributed |
| 267 | 124600CD1 | |
| 268 | 994387.65 | Female Genitalia - 12% |
| 269 | 201462.7 | Embryonic Structures - 69%, Nervous System - 15%, Digestive System- 15% |
| 270 | 991497.1 | Unclassified/Mixed - 16%, Sense Organs - 11% |
| 271 | 347444.1 | Liver - 31%, Urinary Tract-24%, Female Genitalia - 17% |
| 272 | 238660.5 | Digestive System - 56%, Pancreas - 24%, Respiratory System - 11% |
| 273 | 404601.11 | Unclassified/Mixed - 23%, Musculoskeletal System - 12% |
| 274 | 1329936.3 | Cardiovascular System - 12%, Pancreas - 10% |
| 275 | 370489.47 | Cardiovascular System - 28%, Germ Cells - 25%, Hemic and Immune System - 21% |
| 276 | 197185.2 | Digestive System - 100% |
| 278 | 1822864CD1 | |
| 280 | 2258794CD1 | |
| 282 | 000506CD1 | |
| 283 | 407263.1 | Liver - 26%, Pancreas - 18%, Digestive System - 12% |
| 285 | 1630551CD1 | |
| 287 | 2558815CD1 | |
| 288 | 347411.1 | Female Genitalia - 50%, Urinary Tract - 40%, Nervous System - 10% |
| 289 | 92230.2 | Male Genitalia - 23%, Connective Tissue - 18%, Urinary Tract - 18% |
| 290 | 333989.1 | Connective Tissue - 21%, Respiratory System - 15%, Nervous System- 15% |
| 291 | 333542.1 | Germ Cells - 22%, Unclassified/Mixed - 22%, Embryonic Structures - 16% |
| 293 | 2426210CD1 | |
| 294 | 476760.12 | Endocrine System - 25%, Male Genitalia - 25%, Respiratory System - 19%, Nervous System - 19% |
| 296 | 064987CD1 | |
| 297 | 8450.1 | Exocrine Glands - 67%, Male Genitalia - 33% |
| 298 | 197652.3 | Germ Cells - 41% |
| 299 | 248203.2 | Unclassified/Mixed - 10% |
| 301 | 2023351CD1 | |
| 302 | 228610.1 | Germ Cells - 36%, Exocrine Glands - 11%, Unclassified/Mixed - 11% |
| 303 | 92268.1 | Skin - 18%, Urinary Tract - 14%, Female Genitalia - 12% |
| 304 | 16566.1 | Digestive System - 80%, Nervous System - 20% |
| 305 | 1329120.1 | Male Genitalia - 67%, Nervous System - 33% |
| 306 | 898877.6 | widely distributed |
| 307 | 29490.1 | Digestive System - 64%, Pancreas - 36% |
| 309 | 2619838CD1 | |
| 310 | 369213.42 | Urinary Tract - 25%, Digestive System - 25%, Respiratory System - |
| 312 | 3557818CD1 | |
| 314 | 001622CD1 | |
| 315 | 223407.4 | Sense Organs - 13%, Nervous System - 12%, Endocrine System - |
| 316 | 899334.1 | Embryonic Structures - 15% |
| 317 | 237299.13 | Skin - 47%, Male Genitalia - 13%, Urinary Tract - 13% |
| 318 | 1149046.1 | widely distributed |
| 319 | 404011.3 | Germ Cells - 73%, Unclassified/Mixed - 24% |
| 321 | 3768043CD1 | |
| 322 | 39946.19 | Urinary Tract - 17% |
| 324 | 1723834CD1 | |
| 326 | 2551987CD1 | |
| 327 | 232772.13 | Germ Cells - 33%, Connective Tissue - 18%, Liver - 11% |
| 328 | 407451.3 | Hemic and Immune System - 30%, Pancreas - 22%, Unclassified/Mixed - 15% |
| 329 | 1382931.2 | Cardiovascular System - 10% |
| 330 | 1382931.39 | Stomatognathic System - 13% |
| 331 | 411059.1 | Male Genitalia - 64%, Digestive System - 36% |
| 332 | 474862.8 | Sense Organs - 41%, Female Genitalia - 13%, Digestive System - |
| 333 | 402366.1 | Skin - 45%, Male Genitalia - 23%, Female Genitalia - 16% |
| 334 | 401532.3 | Male Genitalia - 67%, Nervous System - 33% |
| 335 | 401532.2 | Liver - 38%, Stomatognathic System - 24% |
| 336 | 407896.4 | Nervous System - 55%, Endocrine System - 30%, Female Genitalia - 11% |

TABLE 5-continued

| SEQ ID NO | Template ID | Tissue Distribution |
|---|---|---|
| 337 | 982625.1 | Nervous System - 100% |
| 338 | 59947.1 | Embryonic Structures - 75%, Nervous System - 25% |
| 339 | 902471.11 | Connective tissue - 32%, Liver - 14%, Urinary Tract - 13% |
| 340 | 442308.1 | Endocrine System - 72%, Nervous System - 28% |
| 341 | 193755.1 | Germ Cells - 11% |
| 342 | 60957.1 | Nervous System - 100% |
| 343 | 5124.23 | Connective Tissue - 30%, Digestive System - 17%, Unclassified/Mixed- 17% |
| 344 | 344166.2 | Stomatognathic System - 17%, Sense Organs - 12%, Embryonic Structures - 10% |
| 345 | 1129157.1 | Stomatognathic System - 11% |
| 347 | 1804734CD1 | |
| 348 | 43646.7 | widely distributed |
| 349 | 43646.1 | Cardiovascular System - 16%, Pancreas - 5%, Skin - 12% |
| 351 | 4674640CD1 | |
| 352 | 25423.3 | Male Genitalia - 57%, Nervous System - 29%, Hemic and Immune System - 14% |
| 353 | 415378.3 | Germ Cells - 17%, Embryonic Structures - 14%, Female Genitalia - |
| 354 | 25685.3 | Endocrine System - 35%, Unclassified/Mixed - 31%, Digestive System - 23% |
| 355 | 400427.1 | Liver - 34%, Nervous System - 15%, Digestive System - 15% |
| 356 | 198008.8 | Germ Cells - 22%, Unclassified/Mixed - 14% |
| 358 | 1825508CD1 | |
| 359 | 236957.9 | Exocrine Glands - 20%, Hemic and Immune System - 18%, Digestive System - 12% |
| 360 | 980807.1 | Hemic and Immune System - 60%, Nervous System - 40% |
| 361 | 1095192.1 | Nervous System - 54%, Liver - 32%, Respiratory System - 11% |
| 362 | 167559.1 | Nervous System - 37%, Endocrine System - 22%, Unclassified/Mixed - 20% |
| 363 | 1383286.12 | Endocrine System - 11%, Respiratory System - 10% |
| 364 | 40790.1 | Sense Organs - 62%, Embryonic Structures - 23%, Respiratory System - 12% |
| 365 | 53059.11 | Unclassified/Mixed - 18%, Embryonic Structures - 13%, Germ Cells - 11% |
| 366 | 337156.2 | Sense Organs - 30%, Male Genitalia - 19% |
| 367 | 349630.7 | Urinary Tract - 38%, Pancreas - 20%, Germ Cells - 15% |
| 369 | 212508CD1 | |
| 370 | 1400574.1 | Unclassified/Mixed - 31%, Nervous System - 15%, Cardiovascular System - 15% |
| 371 | 994430.15 | Pancreas - 18%, Liver - 11%, Germ Cells - 10% |
| 373 | 2631218CD1 | |
| 375 | 3688791CD1 | |
| 377 | 3283554CD1 | |
| 379 | 4960375CD1 | |
| 380 | 222956.22 | Female Genitalia - 15%, Exocrine Glands - 15%, Hemic and Immune System - 15% |
| 381 | 222956.24 | Embryonic Structures - 17%, Unclassified/Mixed - 10% |
| 382 | 973308.1 | widely distributed |
| 383 | 238026.4 | Germ Cells - 19%, Connective Tissue - 13% |
| 384 | 1094829.52 | Liver - 11%, Musculoskeletal System - 11% |
| 385 | 1094829.54 | widely distributed |
| 386 | 899802.1 | Skin - 22%, Unclassified/Mixed - 13%, Embryonic Structures - 11% |
| 387 | 107569.15 | Nervous System - 12% |
| 388 | 236605.2 | Male Genitalia - 16%, Skin - 16%, Germ Cells - 15% |
| 390 | 2705321CD1 | |
| 391 | 383863.2 | Stomatognathic System - 22%, Connective Tissue - 13% |
| 392 | 903491.4 | Female Genitalia - 15%, Germ Cells - 14% |
| 393 | 332755.5 | Nervous System - 34%, Skin - 12%, Endocrine System - 11% |
| 394 | 201694.5 | Urinary Tract - 15%, Stomatognathic System - 14%, Skin - 10% |
| 395 | 65367.1 | Endocrine System - 67%, Male Genitalia - 33% |
| 396 | 199140.9 | Stomatognathic System - 38% |
| 397 | 1088542.9 | Cardiovascular System - 28%, Female Genitalia - 18%, Urinary Tract - 18% |
| 398 | 233513.2 | Nervous System - 13%, Germ Cells - 13%, Urinary Tract - 11% |
| 399 | 1330257.53 | Sense Organs - 36% |
| 401 | 3676741CD1 | |
| 402 | 346636.6 | Nervous System - 82%, Musculoskeletal System - 18% |
| 404 | 1640555CD1 | |
| 405 | 199286.3 | Endocrine System - 33%, Male Genitalia - 33%, Respiratory System - 25% |
| 406 | 199286.2 | Germ Cells - 68%, Sense Organs - 12% |
| 407 | 474200.1 | Unclassified/Mixed - 47%, Embryonic Structures - 18% |
| 408 | 206397.1 | Connective Tissue - 78%, Urinary Tract - 22% |
| 409 | 199584.1 | Unclassified/Mixed - 14% |
| 410 | 401736.1 | Unclassified/Mixed - 13%, Skin - 10% |
| 411 | 1100773.2 | Unclassified/Mixed - 27%, Urinary Tract - 17%, Exocrine Glands - |
| 412 | 167854.1 | Exocrine Glands - 67%, Nervous System - 17%, Hemic and Immune System - 17% |
| 414 | 1693903CD1 | |
| 415 | 351432.23 | Liver 23%, Skin - 14%, Embryonic Structures - 14% |
| 417 | 1252096CD1 | |
| 419 | 2545475CD1 | |
| 421 | 1756951CD1 | |
| 422 | 220134.6 | Skin - 25%, Liver - 14% |
| 423 | 220134.5 | Male Genitalia - 15%, Urinary Tract - 12%, Liver - 12% |
| 424 | 202164.1 | Exocrine Glands - 16%, Respiratory System - 10%, Endocrine System - 10% |
| 425 | 406846.4 | Unclassified/Mixed - 12%, Embryonic Structures - 11% |
| 427 | 2716815CD1 | |
| 428 | 222278.1 | Exocrine Glands - 26%, Embryonic Structures - 10%, Urinary Tract - 12% |
| 430 | 1273292CD1 | |
| 431 | 67855.1 | Germ Cells - 70%, Respiratory System - 14%, Exocrine Glands - 11% |
| 432 | 27185.1 | Unclassified/Mixed - 63%, Exocrine Glands - 30% |
| 433 | 240057.2 | Germ Cells - 43%, Unclassified/Mixed - 34%, Male Genitalia - 22% |
| 434 | 17090.1 | Germ Cells - 65%, Digestive System - 22% |
| 435 | 17021.2 | Germ Cells - 64%, Unclassified/Mixed - 27% |
| 436 | 235682.5 | Male Genitalia - 100% |
| 437 | 399329.3 | Germ Cells - 63%, Unclassified/Mixed - 14% |
| 438 | 68862.1 | Unclassified/Mixed - 80%, Male Genitalia - 20% |
| 439 | 8603.3 | Male Genitalia - 100% |
| 440 | 337647.1 | Respiratory System - 36%, Endocrine System - 29%, Male Genitalia - 14%, Female Genitalia - 14% |
| 441 | 200268.3 | Unclassified/Mixed - 20%, Urinary Tract - 13%, Digestive System - |
| 443 | 168861CD1 | |
| 444 | 334738.1 | Skin - 20%, Pancreas - 19%, Unclassified/Mixed - 17% |
| 445 | 410042.1 | Embryonic Structures - 21%, Unclassified/Mixed - 15%, Connective Tissue - 13% |
| 447 | 2026270CD1 | |
| 449 | 522433CD1 | |
| 450 | 234987.1 | Hemic and Immune System - 80%, Nervous System - 20% |

TABLE 5-continued

| SEQ ID NO | Template ID | Tissue Distribution |
|---|---|---|
| 451 | 1330257.32 | Hemic and Immune System - 100% |
| 452 | 407023.1 | Sense Organs - 81% |
| 454 | 3117184CD1 | |
| 456 | 3105671CD1 | |
| 458 | 2051966CD1 | |
| 460 | 1969731CD1 | |
| 462 | 2171401CD1 | |
| 463 | 1326983.14 | widely distributed |
| 464 | 339106.1 | Respiratory System - 100% |
| 465 | 331666.1 | Germ Cells - 51%, Unclassified/Mixed - 13% |
| 467 | 1422432CD1 | |
| 468 | 409895.2 | Digestive System - 18%, Embryonic Structures - 17%, Liver - 16% |
| 469 | 245136.9 | Male Genitalia - 30%, Female Genitalia - 20% |
| 471 | 2600262CD1 | |
| 472 | 70246.1 | Respiratory System - 38%, Female Genitalia - 25%, Digestive System - 25% |
| 473 | 1086183.1 | Liver - 25%, Skin - 20%, Hemic and Immune System - 14% |
| 474 | 900070.12 | Embryonic Structures - 14%, Stomatognathic System - 13% |
| 475 | 231182.1 | Unclassified/Mixed - 43%, Pancreas - 16% |
| 476 | 12417.1 | Pancreas-100% |
| 477 | 237754.1 | Germ Cells - 33%, Urinary Tract - 17% |
| 479 | 1256053CD1 | |
| 480 | 238391.3 | Respiratory System - 21%, Germ Cells - 18%, Digestive System - |
| 481 | 201945.4 | Urinary Tract - 27%, Unclassified/Mixed - 26% |
| 482 | 235725.21 | widely distributed |
| 483 | 406031.5 | Germ Cells - 35%, Embryonic Structures - 12%, Liver - 12% |
| 484 | 998941.1 | Exocrine Glands - 27%, Connective Tissue - 17% |
| 485 | 243985.1 | Unclassified/Mixed - 21%, Germ Cells - 16% |
| 486 | 481779.1 | Unclassified/Mixed - 37%, Germ Cells - 29% |
| 487 | 982633.1 | Endocrine System - 13%, Embryonic Structures - 13%, Liver - 13% |
| 489 | 2120743CD1 | |
| 490 | 26914.1 | Endocrine System - 38%, Connective Tissue - 29%, Exocrine Glands- 17% |
| 491 | 199121.14 | Cardiovascular System - 17%, Connective Tissue - 13%, Respiratory System - 11% |
| 493 | 1960207CD1 | |
| 494 | 391185.13 | Sense Organs - 11% |
| 495 | 206866.1 | Male Genitalia - 47%, Exocrine Glands - 21% |
| 496 | 1330257.51 | widely distributed |
| 497 | 983942.1 | Germ Cells - 49%, Nervous System - 45% |
| 498 | 223416.15 | Nervous System - 100% |
| 499 | 5876.1 | Cardiovascular System - 28%, Urinary Tract - 24%, Hemic and Immune System - 24% |
| 500 | 303545.3 | Cardiovascular System - 100% |
| 501 | 331571.1 | Cardiovascular System - 42%, Digestive System - 21%, Respiratory System - 16%, Nervous System - 16% |
| 503 | 2246292CD1 | |
| 504 | 411449.1 | Stomatognathic System - 15% |
| 505 | 409853.3 | Male Genitalia - 17%, Cardiovascular System - 11% |
| 507 | 6301537CD1 | |
| 508 | 1398801.9 | Unclassified/Mixed - 19%, Skin - 15%, Urinary Tract - 12% |
| 509 | 1398801.5 | Germ Cells - 36%, Unclassified/Mixed - 18% |
| 510 | 14538.1 | Pancreas- 64%, Female Genitalia - 14%, Male Genitalia - 14% |
| 511 | 14007.1 | Male Genitalia - 100% |
| 512 | 239996.2 | Hemic and Immune System - 100% |
| 513 | 238403.2 | Unclassified/Mixed - 16% |
| 514 | 234681.2 | Sense Organs - 11%, Stomatognathic System - 11%, Urinary Tract - 10% |
| 515 | 228678.1 | Unclassified/Mixed - 28%, Exocrine Glands - 14%, Respiratory System - 12%, Liver- 12% |
| 516 | 233218.22 | Liver - 65%, Cardiovascular System - 11% |
| 517 | 233218.18 | Liver - 48% |
| 518 | 6320.1 | Unclassified/Mixed - 42%, Respiratory System - 26%, Exocrine Glands -21% |
| 519 | 15433.1 | Male Genitalia - 58%, Respiratory System - 42% |
| 521 | 1600311CD1 | |
| 522 | 335999.1 | Sense Organs - 45%, Urinary Tract - 25%, Nervous System - 11% |
| 523 | 197523.6 | Unclassified/Mixed - 15%, Male Genitalia - 12%, Embryonic Structures - 12% |
| 524 | 12833.1 | Pancreas - 87% |
| 525 | 1080598.1 | Embryonic Structures - 15%, Germ Cells - 14%, Unclassified/Mixed - 14% |
| 527 | 2239738CD1 | |
| 528 | 87074.1 | Nervous System - 18%, Embryonic Structures - 13%, Unclassified/Mixed - 12% |
| 529 | 12039.1 | Female Genitalia - 83%, Nervous System - 17% |
| 531 | 1730175CD1 | |
| 533 | 6825202CD1 | |
| 534 | 25613.1 | Endocrine System - 30%, Female Genitalia - 14%, Skin - 12% |
| 536 | 3027821CD1 | |
| 537 | 480736.41 | Unclassified/Mixed - 12%, Skin - 12% |
| 538 | 236943.1 | Cardiovascular System - 28%, Unclassified/Mixed - 28%, Female Genitalia - 24% |
| 539 | 76636.1 | Exocrine Glands - 57%, Female Genitalia - 29%, Nervous System - |
| 540 | 76644.1 | Respiratory System - 42%, Female Genitalia - 42%, Digestive System - 17% |
| 541 | 76699.1 | Nervous System - 50%, Female Genitalia - 50% |
| 542 | 238140.1 | Connective Tissue - 17%, Male Genitalia - 14%, Exocrine Glands - |
| 543 | 19080.2 | Unclassified/Mixed - 26%, Stomatognathic System - 14% |
| 544 | 274444.1 | Respiratory System - 60%, Male Genitalia - 40% |
| 545 | 279625.1 | Male Genitalia - 67%, Female Genitalia - 33% |
| 546 | 1330220.16 | widely distributed |
| 547 | 99792.1 | Male Genitalia - 40%, Female Genitalia - 40%, Hemic and Immune System - 20% |
| 548 | 5147.1 | Unclassified/Mixed - 26%, Germ Cells - 20%, Male Genitalia - 14% |
| 549 | 272599.1 | Hemic and Immune System - 50%, Female Genitalia - 25%, Male Genitalia - 25% |
| 550 | 238396.1 | Sense Organs - 21%, Unclassified/Mixed - 20%, Skin - 16% |
| 551 | 23904.1 | Liver - 38%, Connective Tissue - 29%, Respiratory System - 13% |
| 552 | 274712.1 | Embryonic Structures - 14%, Pancreas - 14%, Nervous System - |
| 553 | 979567.11 | Endocrine System - 14%, Nervous System - 14% |
| 554 | 234121.1 | Nervous System- 19%, Germ Cells- 18% |
| 555 | 252493.15 | widely distributed |
| 556 | 899766.1 | Sense Organs - 29%, Connective Tissue - 27% |
| 557 | 247423.13 | Stomatognathic System - 14%, Sense Organs - 12% |
| 558 | 334234.2 | Nervous System - 70%, Unclassified/Mixed - 13% |
| 559 | 205672.1 | Liver - 33%, Sense Organs - 27%, Unclassified/Mixed - 17% |
| 560 | 1327024.5 | Embryonic Structures - 31%, Endocrine System - 13% |
| 562 | 2925789CD1 | |
| 563 | 335613.1 | Sense Organs - 55% |
| 564 | 207646.1 | Exocrine Glands - 67%, Male Genitalia - 33% |
| 566 | 1720847CD1 | |
| 568 | 2313349CD1 | |
| 569 | 107939.2 | Embryonic Structures - 13%, Unclassified/Mixed - 10% |
| 570 | 11540.1 | Nervous System - 100% |
| 571 | 78831.1 | Respiratory System - 60%, Female Genitalia - 40% |

TABLE 5-continued

| SEQ ID NO | Template ID | Tissue Distribution |
|---|---|---|
| 572 | 207778.1 | Pancreas - 50%, Female Genitalia - 28%, Exocrine Glands - 22% |
| 573 | 296811.1 | Germ Cells - 23%, Skin - 12% |
| 574 | 333776.1 | Hemic and Immune System - 67%, Male Genitalia - 33% |
| 576 | 1859458CD1 | |
| 578 | 110960CD1 | |
| 579 | 238602.2 | widely distributed |
| 580 | 363007.1 | Connective Tissue - 72%, Male Genitalia - 14%, Exocrine Glands - |
| 582 | 347823CD1 | |
| 584 | 2466714CD1 | |
| 585 | 4208.1 | Endocrine System - 40%, Urinary Tract - 40%, Male Genitalia - 20% |
| 586 | 903475.2 | Nervous System - 25%, Skin 19%, Endocrine System - 18% |
| 587 | 246037.28 | Exocrine Glands - 13%, Respiratory System - 12% |
| 588 | 337183.1 | Liver - 18%, Cardiovascular System - 16%, Digestive System - 16% |
| 590 | 2651836CD1 | |
| 591 | 80339.1 | Endocrine System - 100% |
| 592 | 480968.13 | Germ Cells - 15%, Embryonic Structures - 15% |
| 593 | 337448.1 | Unclassified/Mixed - 50%, Germ Cells - 22%, Male Genitalia - 14% |
| 594 | 5360.1 | Hemic and Immune System - 32%, Exocrine Glands - 21%, Endocrine System - 21% |
| 595 | 998599.8 | Hemic and Immune System - 100% |
| 596 | 332821.13 | Sense Organs - 37%, Germ Cells - 18% |
| 597 | 344186.9 | Cardiovascular System - 100% |
| 598 | 344186.12 | Nervous System - 69%, Cardiovascular System - 31% |
| 599 | 212489.1 | Germ Cells - 27%, Urinary Tract - 19%, Liver - 19% |
| 600 | 80711.1 | Nervous System - 100% |
| 601 | 80787.1 | Nervous System - 100% |
| 602 | 334352.1 | Nervous System - 31%, Unclassified/Mixed - 30%, Liver - 11% |
| 603 | 208376.1 | Male Genitalia - 67%, Nervous System - 33% |
| 604 | 7820.1 | Unclassified/Mixed - 80%, Nervous System - 20% |
| 605 | 81447.1 | Nervous System - 100% |
| 606 | 81821.1 | Nervous System - 100% |
| 607 | 81869.1 | Nervous System - 100% |
| 608 | 210011.1 | Nervous System - 20%, Pancreas - 19%, Endocrine System - 19% |
| 609 | 480336.3 | Pancreas - 21%, Skin - 16%, Embryonic Structures - 10%, Liver - 10% |
| 610 | 1024610.45 | Endocrine System - 19%, Embryonic Structures - 13%, Urinary Tract - 10% |
| 611 | 82013.1 | Urinary Tract - 67%, Nervous System - 17%, Hemic and Immune System - 17% |
| 612 | 212155.1 | Sense Organs - 38%, Endocrine System - 12%, Nervous System - |
| 613 | 22632.1 | Sense Organs - 22%, Germ Cells - 11%, Male Genitalia - 11% |
| 615 | 2789525CD1 | |
| 617 | 1692213CD1 | |
| 618 | 15393.1 | Endocrine System - 50%, Nervous System - 50% |
| 620 | 001089CD1 | |
| 622 | 002484CD1 | |
| 624 | 669671CD1 | |
| 626 | 1344185CD1 | |
| 628 | 697785CD1 | |
| 629 | 336435.2 | Endocrine System - 64%, Respiratory System - 12% |
| 630 | 231558.1 | Endocrine System - 29%, Urinary Tract - 29%, Male Genitalia - 14%, Female Genitalia - 14%, Digestive System - 14% |
| 631 | 247784.3 | Female Genitalia - 21%, Endocrine System - 14%, Nervous System - 14% |
| 632 | 238322.6 | Musculoskeletal System - 27%, Unclassified/Mixed - 11% |
| 633 | 55978.9 | Unclassified/Mixed - 33%, Endocrine System - 12%, Embryonic Structures - 12%, Male Genitalia - 12%, Liver - 12% |
| 634 | 55978.4 | Endocrine System - 15%, Unclassified/Mixed - 13%, Nervous System - 13%, Male Genitalia - 13% |
| 635 | 350977.1 | Pancreas - 14%, Hemic and Immune System - 14%, Cardiovascular System - 13%, Respiratory System - 13%, |
| 636 | 238877.11 | widely distributed |
| 637 | 238877.8 | Sense Organs - 33% |
| 638 | 997231.15 | Musculoskeletal System - 17%, Male Genitalia - 11%, Germ Cells - 10%, Cardiovascular System - 10% |
| 639 | 997231.16 | Germ Cells - 20% |
| 640 | 346209.3 | Digestive System - 24%, Pancreas - 12% |
| 642 | 2515666CD1 | |
| 644 | 2742913CD1 | |
| 645 | 336615.1 | Sense Organs - 58%, Endocrine System - 14%, Nervous System - |
| 646 | 406830.43 | Germ Cells - 36% |
| 647 | 406830.33 | Digestive System - 100% |
| 648 | 84685.1 | Connective Tissue - 64%, Male Genitalia - 18%, Digestive System - |
| 649 | 1045907.4 | Musculoskeletal System - 67%, Respiratory System - 33% |
| 650 | 1383803.2 | Liver - 26%, Embryonic Structures- 14%, Unclassified/Mixed - 12% |
| 651 | 85282.1 | Female Genitalia - 45%, Respiratory System - 27%, Hemic and Immune System - 27% |
| 652 | 86326.1 | Female Genitalia - 29%, Urinary Tract - 24%, Respiratory System - |
| 653 | 337470.1 | Unclassified/Mixed - 57%, Respiratory System - 14%, Liver - 13% |
| 655 | 3721108CD1 | |
| 656 | 1090929.2 | Liver - 28%, Skin - 21% |
| 657 | 95374.1 | Connective Tissue - 47%, Respiratory System - 20%, Hemic and Immune System - 20% |
| 658 | 238639.2 | Female Genitalia - 36%, Urinary Tract - 29%, Hemic and Immune System - 21% |
| 659 | 33627.28 | Connective Tissue - 16%, Liver - 14%, Female Genitalia - 12% |
| 660 | 33627.33 | Germ Cells - 12% |
| 661 | 435361.1 | widely distributed |
| 662 | 474552.1 | Exocrine Glands - 50%, Male Genitalia - 25%, Digestive System - |
| 664 | 2636759CD1 | |
| 665 | 1083665.4 | Hemic and Immune System - 18%, Connective Tissue - 18%, Male Genitalia - 18% |
| 666 | 240518.21 | Connective Tissue - 23%, Liver - 15%, Respiratory System - 13% |
| 667 | 240518.42 | widely distributed |
| 668 | 1322.4 | Respiratory System - 12%, Unclassified/Mixed - 12% Stomatognathic System - 11% |
| 669 | 208282.1 | Unclassified/Mixed - 38%, Embryonic Structures - 14%, Connective Tissue - 11% |
| 670 | 345272.5 | Digestive System - 100% |
| 671 | 345272.2 | Unclassified/Mixed - 18% |
| 672 | 997613.1 | Digestive System - 67%, Cardiovascular System - 22% |
| 673 | 231840.1 | Germ Cells - 30%, Liver - 14% |
| 674 | 13937.3 | Connective Tissue - 18%, Hemic and Immune System - 11% |
| 675 | 253783.6 | Male Genitalia - 41%, Nervous System - 26%, Urinary Tract - 18% |
| 676 | 20828.1 | Embryonic Structures - 60%, Male Genitalia - 13%, Female Genitalia - 13%, Digestive System - 13% |
| 677 | 222705.14 | Embryonic Structures - 25%, Connective Tissue - 12%, Female Genitalia - 11% |

TABLE 5-continued

| SEQ ID NO | Template ID | Tissue Distribution |
|---|---|---|
| 678 | 335906.1 | Female Genitalia - 56%, Endocrine System - 44% |
| 679 | 1325741.2 | Unclassified/Mixed - 17%, Embryonic Structures - 16% |
| 681 | 2703282CD1 | |
| 682 | 118836.2 | Urinary Tract - 12% |
| 683 | 3303.2 | Embryonic Structures - 13% |
| 684 | 92991.1 | Respiratory System - 60%, Nervous System - 20%, Hemic and Immune System - 20% |
| 685 | 93603.1 | Respiratory System - 100% |
| 686 | 1383062.7 | Nervous System - 36%, Skin - 16%, Male Genitalia - 13% |
| 687 | 1383062.8 | Respiratory System - 43%, Nervous System - 29%, Female Genitalia - 29% |
| 688 | 1383794.1 | Female Genitalia - 38%, Endocrine System - 31%, Hemic and Immune System - 31% |
| 689 | 406289.1 | Hemic and Immune System - 59%, Female Genitalia - 29%, Nervous System - 12% |
| 690 | 175918.15 | widely distributed |
| 691 | 1068290.1 | Unclassified/Mixed - 15%, Hemic and Immune System - 13%, Pancreas - 11%, Respiratory System - 11% |
| 692 | 94873.1 | Digestive System - 67%, Hemic and Immune System - 33% |
| 693 | 403616.1 | Embryonic Structures - 39%, Liver - 39%, Hemic and Immune System - 13% |
| 694 | 95088.1 | Hemic and Immune System - 100% |
| 695 | 230402.1 | Embryonic Structures - 30%, Unclassified/Mixed - 27%, Endocrine System - 13%, Urinary Tract - 13% |
| 696 | 95172.1 | Female Genitalia - 67%, Hemic and Immune System - 33% |
| 697 | 250091.1 | Nervous System - 50%, Hemic and Immune System - 50% |
| 699 | 4113161CD1 | |
| 700 | 335375.3 | Liver - 67% |
| 701 | 95395.1 | Hemic and Immune System - 100% |
| 702 | 229514.1 | Urinary Tract - 32%, Cardiovascular System - 18%, Endocrine System - 18% |
| 703 | 95573.1 | Hemic and Immune System - 100% |
| 704 | 230463.1 | Cardiovascular System - 26%, Exocrine Glands - 26%, Urinary Tract - 23% |
| 705 | 95702.1 | Nervous System - 100% |
| 706 | 218090.9 | Sense Organs- 16%, Cardiovascular System - 10% |
| 707 | 96126.1 | Connective Tissue - 78%, Digestive System - 22% |
| 709 | 1508254CD1 | |
| 711 | 207452CD1 | |
| 712 | 290233.1 | Female Genitalia - 100% |
| 713 | 1096917.11 | Exocrine Glands- 67%, Female Genitalia - 17%, Male Genitalia - |
| 714 | 208748.4 | Germ Cells - 23%, Urinary Tract - 13%, Unclassified/Mixed - 11% |
| 715 | 407517.2 | Stomatognathic System - 17%, Urinary Tract - 10% |
| 716 | 233997.1 | Sense Organs- 18% |
| 717 | 237067.1 | Respiratory System - 18%, Unclassified/Mixed - 18%, Male Genitalia - 16% |
| 718 | 330862.6 | Hemic and Immune System - 24%, Exocrine Glands - 16%, Urinary Tract - 16%, Digestive System - 16%, Cardiovascular System - 16% |
| 719 | 330862.8 | Urinary Tract - 12%, Sense Organs - 10%, Germ Cells - 10% |
| 721 | 2124957CD1 | |
| 722 | 1098722.6 | Embryonic Structures - 19%, Musculoskeletal System - 10%, Unclassified/Mixed - 10% |
| 723 | 1099023.1 | Unclassified/Mixed - 53%, Respiratory System - 31%, Exocrine Glands - 13% |
| 724 | 201395.4 | Nervous System - 39%, Endocrine System - 15% |
| 726 | 4295277CD1 | |
| 727 | 98533.1 | Endocrine System - 100% |
| 728 | 983684.1 | Skin - 52%, Unclassified/Mixed - 30%, Hemic and Immune System - |
| 729 | 983684.2 | Unclassified/Mixed - 93% |
| 731 | 1837317CD1 | |
| 733 | 2937262CD1 | |
| 734 | 199290.9 | widely distributed |
| 736 | 3151579CD1 | |
| 737 | 235056.14 | Nervous System - 50%, Hemic and Immune System - 50% |
| 738 | 337939.2 | Hemic and Immune System - 100% |
| 739 | 208379.1 | Nervous System 52%, Embryonic Structures - 21%, Urinary Tract - 17% |
| 740 | 251631.6 | Exocrine Glands - 29%, Digestive System - 29%, Hemic and Immune System - 29% |
| 742 | 2847188CD1 | |
| 743 | 100579.1 | Nervous System - 50%, Hemic and Immune System - 50% |
| 744 | 1327498.1 | Exocrine Glands - 50%, Female Genitalia - 25%, Digestive System - |
| 745 | 1330212.14 | widely distributed |
| 746 | 252471.7 | Respiratory System - 25%, Exocrine Glands - 13%, Urinary Tract - 11%, Connective Tissue - 11%, Female Genitalia - 11% |
| 747 | 252471.4 | Germ Cells - 18%, Unclassified/Mixed - 13% |
| 748 | 983536.1 | Endocrine System - 45%, Female Genitalia - 35%, Male Genitalia - |
| 749 | 983536.2 | Endocrine System - 100% |
| 750 | 1330122.1 | Embryonic Structures - 14%, Sense Organs - 11% |
| 751 | 407468.1 | Germ Cells - 43%, Unclassified/Mixed - 28%, Female Genitalia - |
| 752 | 1330149.46 | Sense Organs - 14%, Hemic and Immune System - 10% |
| 753 | 32476.2 | Unclassified/Mixed - 22%, Cardiovascular System - 17%, Hemic and Immune System - 13%, Female Genitalia - 13% |
| 755 | 1281694CD1 | |
| 757 | 1719478CD1 | |
| 758 | 230611.1 | Respiratory System - 75%, Hemic and Immune System - 25% |
| 759 | 236749.1 | Hemic and Immune System - 50%, Pancreas - 19%, Digestive System - 17% |
| 760 | 407124.2 | Unclassified/Mixed - 29%, Digestive System - 21%, Male Genitalia - |
| 761 | 104322.1 | Pancreas - 38%, Connective Tissue - 29%, Male Genitalia - 17% |
| 762 | 400253.14 | Urinary Tract - 23%, Hemic and Immune System - 15%, Liver - 13%, Nervous System - 13% |
| 763 | 233595.17 | Sense Organs - 30% |
| 764 | 978065.5 | Germ Cells - 47%, Hemic and Immune System - 11%, Unclassified/Mixed - 10% |
| 765 | 403642.1 | Hemic and Immune System - 100% |
| 766 | 984236.4 | Digestive System - 80%, Nervous System - 10%, Hemic and Immune System - 10% |
| 767 | 984236.1 | Digestive System - 35%, Liver - 26%, Female Genitalia - 15% |
| 769 | 1001589CD1 | |
| 770 | 7808.1 | Hemic and Immune System - 21%, Liver - 20% |
| 771 | 403627.38 | Nervous System - 13%, Urinary Tract - 12%, Endocrine System - 11% |
| 772 | 106415.1 | Endocrine System - 100% |
| 773 | 474622.1 | Skin - 15%, Unclassified/Mixed - 10% |
| 774 | 1383009.57 | Endocrine System - 10% |
| 775 | 1383009.67 | widely distributed |
| 776 | 1086355.2 | Urinary Tract - 80%, Nervous System - 20% |

TABLE 5-continued

| SEQ ID NO | Template ID | Tissue Distribution |
|---|---|---|
| 777 | 1086355.1 | Germ Cells - 23%, Nervous System - 12%, Endocrine System - 12% |
| 778 | 998330.2 | Urinary Tract - 36%, Respiratory System - 27%, Female Genitalia - |
| 779 | 1384716.4 | Exocrine Glands - 10% |
| 781 | 2790762CD1 | |
| 782 | 399607.1 | Endocrine System - 56%, Urinary Tract - 25%, Nervous System - 13% |
| 783 | 256138.1 | Urinary Tract - 67%, Male Genitalia - 33% |
| 784 | 413348.4 | Liver - 15%, Digestive System - 11% |
| 785 | 332088.2 | Cardiovascular System - 67%, Nervous System - 17%, Hemic and Immune System - 17% |
| 787 | 035282CD1 | |
| 788 | 350667.7 | Cardiovascular System - 38%, Urinary Tract - 19%, Hemic and Immune System - 19% |
| 789 | 343913.1 | Hemic and Immune System - 100% |
| 790 | 211622.1 | Respiratory System - 60%, Nervous System - 20%, Hemic and Immune System - 20% |
| 791 | 110049.1 | Musculoskeletal System - 76%, Cardiovascular System - 24% |
| 793 | 1806212CD1 | |
| 795 | 4436028CD1 | |
| 796 | 406663.3 | Hemic and Immune System - 50%, Respiratory System - 21%, Digestive System - 14%, Male Genitalia - 14% |
| 797 | 405689.1 | Liver - 69%, Male Genitalia - 27% |
| 798 | 110815.1 | Hemic and Immune System - 100% |
| 799 | 1385527.4 | Stomatognathic System - 26% |
| 800 | 2570.1 | Sense Organs - 69%, Skin - 19% |
| 801 | 1100724.1 | Germ Cells - 11%, Exocrine Glands - 10% |
| 803 | 3704760CD1 | |
| 804 | 344017.6 | Sense Organs - 33%, Liver - 11%, Hemic and Immune System - 10% |
| 805 | 344017.3 | Skin - 22% |
| 807 | 2770104CD1 | |
| 808 | 349204.1 | Hemic and Immune System - 67%, Male Genitalia - 22%, Nervous System - 11% |
| 810 | 2641740CD1 | |
| 811 | 211881.1 | Female Genitalia - 83%, Hemic and Immune System - 17% |
| 812 | 334749.1 | Connective Tissue - 88% |
| 813 | 407838.1 | Musculoskeletal System - 60%, Respiratory System - 30%, Nervous System - 10% |
| 815 | 170915CD1 | |
| 816 | 994387.88 | Nervous System - 100% |
| 818 | 2454013CD1 | |
| 819 | 427967.6 | Embryonic Structures - 50%, Exocrine Glands - 44% |
| 820 | 427967.4 | Embryonic Structures - 12% |
| 821 | 257016.1 | Connective Tissue - 50%, Respiratory System - 18%, Endocrine System - 14%, Exocrine Glands - 14% |
| 822 | 215158.5 | Liver - 13%, Nervous System - 12%, Unclassified/Mixed - 11% |
| 823 | 522.12 | Exocrine Glands - 31%, Digestive System - 31%, Female Genitalia - 15%, Nervous System - 15% |
| 824 | 522.1 | Cardiovascular System - 67%, Female Genitalia - 33% |
| 825 | 113633.1 | Digestive System - 50%, Female Genitalia - 25%, Nervous System - 13%, Hemic and Immune System - 13% |
| 826 | 477387.3 | Hemic and Immune System - 60%, Digestive System - 40% |
| 827 | 477387.7 | Stomatognathic System - 19%, Unclassified/Mixed - 17%, Skin - |
| 828 | 347796.7 | Stomatognathic System - 11% |
| 830 | 2656429CD1 | |
| 832 | 3346307CD1 | |
| 834 | 2649071CD1 | |
| 835 | 1383086.2 | Germ Cells - 15%, Exocrine Glands - 14%, Male Genitalia - 11% |
| 837 | 1850670CD1 | |
| 838 | 1132386.3 | Urinary Tract - 19%, Nervous System - 18%, Unclassified/Mixed - |
| 839 | 115052.1 | Cardiovascular System - 100% |
| 841 | 1330056CD1 | |
| 842 | 199788.2 | widely distributed |
| 843 | 27881.1 | Exocrine Glands - 53%, Cardiovascular System - 27%, Nervous System - 13% |
| 844 | 234543.1 | Sense Organs - 20%, Germ Cells - 20%, Musculoskeletal System - |
| 845 | 231547.2 | Pancreas - 36%, Female Genitalia - 20%, Exocrine Glands - 16%, Endocrine System - 16% |
| 846 | 399785.1 | Pancreas - 32%, Unclassified/Mixed - 29%, Male Genitalia - 14%, Cardiovascular System - 14% |
| 847 | 10498.24 | Embryonic Structures - 21% |
| 848 | 399161.1 | Nervous System - 40%, Exocrine Glands - 40%, Female Genitalia - |
| 849 | 241467.1 | Germ Cells - 75%, Endocrine System - 13% |
| 850 | 997194.1 | Embryonic Structures - 43%, Connective Tissue - 33%, Cardiovascular System - 19% |
| 851 | 17819.1 | Connective Tissue - 24%, Embryonic Structures - 15%, Cardiovascular System - 14%, Exocrine Glands - 14% |
| 852 | 116536.1 | Cardiovascular System - 36%, Urinary Tract - 36%, Digestive System - 18% |
| 853 | 116549.1 | Liver - 90%, Hemic and Immune System - 10% |
| 854 | 17886.1 | Hemic and Immune System - 100% |
| 855 | 351032.1 | Embryonic Structures - 64%, Hemic and Immune System - 29% |
| 856 | 977532.9 | Sense Organs - 23%, Unclassified/Mixed - 13% |
| 857 | 117273.1 | Male Genitalia - 100% |
| 858 | 212438.1 | Embryonic Structures - 50%, Exocrine Glands - 22%, Female Genitalia - 11%, Digestive System - 11% |
| 859 | 212265.7 | Male Genitalia - 33%, Digestive System - 33%, Nervous System - 17%, Hemic and Immune System - 17% |
| 860 | 403560.1 | Digestive System - 91% |
| 861 | 1073168.6 | Unclassified/Mixed - 32%, Exocrine Glands - 16%, Urinary Tract - |
| 862 | 1073168.8 | widely distributed |
| 863 | 119614.1 | Female Genitalia - 100% |
| 864 | 119625.1 | Female Genitalia - 67%, Hemic and Immune System - 33% |
| 865 | 119671.1 | Female Genitalia - 100% |
| 866 | 3177.1 | Female Genitalia - 15%, Urinary Tract - 13%, Embryonic Structures - 11%, Liver - 11% |
| 867 | 119974.1 | Female Genitalia - 100% |
| 868 | 120831.1 | Endocrine System - 57%, Digestive System - 29%, Hemic and Immune System - 14% |
| 869 | 27619.3 | Liver - 91% |
| 870 | 212872.1 | Nervous System - 37%, Urinary Tract - 26%, Respiratory System - 19%, Female Genitalia - 19% |
| 871 | 404952.4 | Sense Organs - 35%, Liver - 18% |
| 872 | 404952.1 | Germ Cells - 20% |
| 873 | 125014.1 | Connective Tissue - 88%, Hemic and Immune System - 13% |
| 874 | 348390.2 | Digestive System - 44%, Male Genitalia - 21%, Female Genitalia - |
| 875 | 227222.1 | Pancreas - 56%, Cardiovascular System - 25%, Respiratory System - 19% |

TABLE 5-continued

| SEQ ID NO | Template ID | Tissue Distribution |
|---|---|---|
| 876 | 337696.1 | Connective Tissue - 50%, Respiratory System - 21%, Digestive System - 14% |
| 877 | 253550.2 | Connective Tissue - 30%, Endocrine System - 14% |
| 878 | 1326925.1 | Liver - 47%, Digestive System - 42%, Male Genitalia - 11% |
| 879 | 127140.1 | Male Genitalia - 100% |
| 880 | 127204.1 | Male Genitalia - 100% |
| 881 | 330925.1 | Germ Cells - 37%, Sense Organs - 18% |
| 882 | 403960.1 | Unclassified/Mixed - 36%, Female Genitalia - 23%, Endocrine System - 18% |
| 883 | 20152.1 | Liver - 19%, Cardiovascular System - 17%, Respiratory System - 17%, Unclassified/Mixed - 17% |
| 884 | 26200.1 | Skin - 54%, Musculoskeletal System - 23%, Exocrine Glands - 15% |
| 885 | 399474.1 | Skin - 17% |
| 886 | 981037.1 | Digestive System - 50%, Pancreas - 25%, Endocrine System - 11% |
| 887 | 130502.1 | Female Genitalia - 100% |
| 889 | 5202390CD1 | |
| 890 | 213447.4 | Unclassified/Mixed - 51%, Respiratory System - 13% |
| 891 | 250439.1 | Respiratory System - 100% |
| 893 | 2743049CD1 | |
| 894 | 256026.8 | Embryonic Structures - 28%, Liver - 28%, Respiratory System - 25% |
| 895 | 998930.1 | Musculoskeletal System - 68%, Exocrine Glands - 21%, Female Genitalia - 11% |
| 896 | 981149.2 | Connective Tissue - 36%, Urinary Tract - 18%, Nervous System - 13%, Female Genitalia - 13% |
| 897 | 335420.1 | Endocrine System - 69%, Nervous System - 23% |
| 898 | 1082203.1 | Embryonic Structures - 23%, Endocrine System - 11%, Male Genitalia - 11% |
| 899 | 225420.1 | Unclassified/Mixed - 14%, Female Genitalia - 12%, Male Genitalia - |
| 900 | 236298.4 | Germ Cells - 28% |
| 901 | 236298.2 | Endocrine System - 20%, Hemic and Immune System - 17%, Embryonic Structures - 10%, Liver - 10% |
| 902 | 982813.1 | Nervous System - 75%, Digestive System - 25% |
| 903 | 154771.1 | Urinary Tract - 64%, Female Genitalia - 18%, Digestive System - |
| 904 | 477054.1 | Respiratory System - 92% |
| 905 | 2966.1 | Musculoskeletal System - 54%, Cardiovascular System - 33% |
| 906 | 136212.1 | Cardiovascular System - 100% |
| 907 | 977975.1 | Sense Organs- 16%, Stomatognathic System - 12%, Connective Tissue - 11% |
| 909 | 1505038CD1 | |
| 911 | 262830CD1 | |
| 913 | 3607580CD1 | |
| 914 | 137742.1 | Respiratory System - 56%, Male Genitalia - 22%, Female Genitalia - |
| 915 | 1095839.1 | Sense Organs - 16%, Skin - 11% |
| 916 | 205328.1 | Unclassified/Mixed - 41%, Pancreas - 22%, Female Genitalia - 17% |
| 917 | 252649.14 | Urinary Tract- 16%, Digestive System - 11% |
| 918 | 221762.2 | Liver - 50%, Hemic and Immune System - 19%, Cardiovascular System - 12% |
| 919 | 138205.1 | Respiratory System - 60%, Female Genitalia - 40% |
| 920 | 331566.1 | Unclassified/Mixed - 26%, Embryonic Structures - 14%, Stomatognathic System - 12% |
| 921 | 1384719.3 | widely distributed |
| 922 | 1330137.1 | Respiratory System - 100% |
| 923 | 409962.1 | Germ Cells - 65%, Embryonic Structures - 23%, Cardiovascular System - 10% |
| 924 | 481118.7 | Exocrine Glands - 16%, Female Genitalia - 11%, Cardiovascular System - 10% |
| 925 | 481118.12 | Stomatognathic System - 11% |
| 926 | 337528.4 | Pancreas - 17%, Embryonic Structures - 17%, Male Genitalia - 17%, Liver- 17% |
| 928 | 3687719CD1 | |
| 929 | 332299.1 | Exocrine Glands - 32%, Embryonic Structures - 24%, Respiratory System - 14% |
| 931 | 1530186CD1 | |
| 932 | 251809.1 | Male Genitalia - 100% |
| 933 | 334025.5 | Embryonic Structures - 36%, Cardiovascular System - 16%, Male Genitalia - 16%, Exocrine Glands - 16% |
| 934 | 350134.1 | Cardiovascular System - 67%, Respiratory System - 25% |
| 935 | 16124.2 | Cardiovascular System - 67%, Female Genitalia - 33% |
| 936 | 140468.1 | Cardiovascular System - 100% |
| 938 | 3257507CD1 | |
| 939 | 1400580.1 | Musculoskeletal System - 24%, Female Genitalia - 20%, Exocrine Glands - 16%, Urinary Tract - 16%, Digestive System - 16% |
| 940 | 481154.3 | Unclassified/Mixed - 29%, Urinary Tract - 12%, Female Genitalia - |
| 941 | 346716.17 | Unclassified/Mixed - 14%, Female Genitalia - 11%, Liver - 11% |
| 942 | 346716.21 | Cardiovascular System - 22%, Nervous System - 17%, Urinary Tract - 13%, Male Genitalia - 13% |
| 943 | 1384720.16 | Stomatognathic System - 12% |
| 945 | 1505790CD1 | |
| 947 | 3876162CD1 | |
| 948 | 40576.1 | Sense Organs - 46%, Urinary Tract - 12%, Nervous System - 12% |
| 949 | 1040190.14 | Sense Organs - 36%, Hemic and Immune System - 21%, Embryonic Structures - 19% |
| 950 | 1328310.1 | Liver - 67%, Exocrine Glands - 15%, Respiratory System - 11% |
| 951 | 34297.1 | Nervous System - 100% |
| 952 | 145549.2 | Urinary Tract - 100% |
| 953 | 42206.1 | Liver - 31%, Pancreas - 31%, Cardiovascular System - 14% |
| 954 | 178799.1 | Liver - 30%, Unclassified/Mixed - 27%, Respiratory System - 17% |
| 955 | 214767.1 | Male Genitalia - 100% |
| 956 | 94384.1 | Endocrine System - 40%, Exocrine Glands - 40%, Nervous System - 10%, Hemic and Immune System - 10% |
| 958 | 2852561CD1 | |
| 959 | 337058.1 | Respiratory System - 28%, Nervous System - 28%, Endocrine System - 22% |
| 960 | 988704.25 | widely distributed |
| 961 | 988704.26 | Exocrine Glands - 11% |
| 962 | 401906.2 | Respiratory System - 100% |
| 963 | 154220.1 | Respiratory System - 75%, Nervous System - 25% |
| 965 | 5371205CD1 | |
| 966 | 147026.1 | Nervous System - 100% |
| 967 | 410776.1 | Hemic and Immune System - 86%, Nervous System - 14% |
| 968 | 335121.1 | Germ Cells - 67%, Exocrine Glands - 10%, Urinary Tract - 10%, Digestive System - 10% |
| 969 | 147379.1 | Nervous System - 100% |
| 970 | 147403.1 | Embryonic Structures - 69%, Nervous System - 23% |
| 971 | 1041063.1 | Liver - 38%, Respiratory System - 33%, Male Genitalia - 17% |
| 972 | 1041063.5 | Pancreas - 32%, Respiratory System - 18%, Exocrine Glands - 14%, Urinary Tract - 14%, Hemic and Immune System - 14% |

TABLE 5-continued

| SEQ ID NO | Template ID | Tissue Distribution |
|---|---|---|
| 973 | 230912.1 | Cardiovascular System - 44%, Respiratory System - 33%, Nervous System - 11%, Hemic and Immune System - 11% |
| 974 | 1089708.18 | Nervous System - 11%, Embryonic Structures - 10% |
| 975 | 1050390.1 | Skin - 58%, Pancreas - 38% |
| 977 | 088957CD1 | |
| 978 | 220943.21 | Connective Tissue - 12%, Cardiovascular System - 12% |
| 979 | 28005.14 | Liver - 40%, Musculoskeletal System - 14% |
| 980 | 980446.1 | Embryonic Structures - 29%, Male Genitalia - 14%, Nervous System - 14% |
| 981 | 198827.1 | Connective Tissue - 23%, Nervous System - 17%, Exocrine Glands - 11% |
| 982 | 215112.1 | Male Genitalia - 80%, Nervous System - 20% |
| 983 | 977929.1 | Sense Organs - 46%, Male Genitalia - 11% |
| 984 | 281447.2 | Urinary Tract - 67%, Digestive System - 33% |
| 985 | 346641.3 | Unclassified/Mixed - 31%, Connective Tissue - 27%, Exocrine Glands- 15% |
| 986 | 230793.3 | Unclassified/Mixed - 27%, Exocrine Glands - 11%, Hemic and Immune System - 11% |
| 987 | 431288.1 | Respiratory System - 87%, Nervous System - 13% |
| 989 | 4215034CD1 | |
| 990 | 150627.1 | Pancreas- 96% |
| 991 | 121731.1 | Pancreas - 86%, Hemic and Immune System - 14% |
| 992 | 259907.1 | Pancreas - 100% |
| 993 | 977727.13 | Pancreas - 66%, Liver - 22% |
| 994 | 5915.1 | Respiratory System - 42%, Urinary Tract - 23%, Hemic and Immune System - 19% |
| 995 | 8835.1 | Nervous System - 57%, Female Genitalia - 29%, Hemic and Immune System - 14% |
| 996 | 242010.6 | Nervous System - 19%, Musculoskeletal System - 15%, Embryonic Structures- 12% |
| 997 | 242684.1 | Exocrine Glands - 31%, Respiratory System - 23%, Hemic and Immune System - 23% |
| 998 | 335145.1 | Nervous System - 33%, Unclassified/Mixed - 18%, Male Genitalia - |
| 1000 | 678004CD1 | |
| 1001 | 92922.1 | Nervous System - 100% |
| 1002 | 411373.7 | Embryonic Structures - 48%, Unclassified/Mixed - 17%, Nervous System - 12% |
| 1003 | 404715.1 | Endocrine System - 44%, Nervous System - 22%, Female Genitalia - 22% |
| 1004 | 278831.1 | Respiratory System - 75%, Nervous System - 25% |
| 1005 | 343924.8 | Skin - 15%, Digestive System - 11%, Respiratory System - 11% |
| 1006 | 200977.1 | Stomatognathic System - 31%, Urinary Tract - 13% |
| 1007 | 181818.3 | Connective Tissue - 39%, Hemic and Immune System - 17%, Male Genitalia - 15% |
| 1009 | 029251CD1 | |
| 1010 | 335648.1 | Liver - 67%, Exocrine Glands - 20%, Unclassified/Mixed - 12% |
| 1011 | 331108.1 | Liver - 72%, Digestive System - 18% |
| 1012 | 333840.1 | Liver - 68%, Urinary Tract - 24% |
| 1013 | 334298.1 | Liver - 75%, Endocrine System - 11%, Hemic and Immune System - |
| 1014 | 344597.2 | Nervous System - 100% |
| 1015 | 1262593.2 | Embryonic Structures - 33%, Unclassified/Mixed - 13% |
| 1016 | 461375.2 | Embryonic Structures - 16%, Connective Tissue - 13% |
| 1017 | 233660.2 | Germ Cells - 12%, Unclassified/Mixed - 10% |
| 1018 | 230179.3 | Liver - 43%, Endocrine System - 10%, Musculoskeletal System- 10% |
| 1019 | 230179.7 | Liver - 25%, Pancreas - 14%, Germ Cells - 10% |
| 1020 | 296245.1 | Female Genitalia - 67%, Nervous System - 33% |
| 1021 | 981208.1 | Pancreas - 31%, Nervous System 17%, Endocrine System - 15% |
| 1022 | 406580.1 | Germ Cells - 54%, Nervous System - 32% |
| 1023 | 200051.1 | Sense Organs - 38%, Nervous System - 20% |
| 1024 | 1197030.1 | Stomatognathic System - 17% |
| 1025 | 1197030.1 | Musculoskeletal System - 14% |
| 1026 | 158859.1 | Endocrine System - 50%, Nervous System - 38%, Hemic and Immune System - 13% |
| 1027 | 229490.1 | Sense Organs - 55%, Connective Tissue - 15% |
| 1029 | 4832672CD1 | |
| 1030 | 339638.1 | Male Genitalia - 44%, Female Genitalia - 22%, Digestive System - |
| 1031 | 480885.2 | Connective Tissue - 14%, Male Genitalia - 13%, Embryonic Structures - 10% |
| 1032 | 342074.1 | Skin - 61%, Respiratory System - 22%, Exocrine Glands - 17% |
| 1033 | 406992.1 | Skin - 48%, Hemic and Immune System - 21%, Exocrine Glands - 14%, Digestive System - 14% |
| 1035 | 1852849CD1 | |
| 1036 | 1132829.1 | Cardiovascular System - 10% |
| 1037 | 339800.1 | Nervous System - 100% |
| 1038 | 1399492.1 | Unclassified/Mixed - 29%, Respiratory System - 16% |
| 1039 | 13039.2 | Sense Organs - 19%, Embryonic Structures - 17% |
| 1040 | 399626.1 | Endocrine System - 69%, Male Genitalia - 15%, Nervous System - |
| 1041 | 365070.3 | Nervous System - 54%, Endocrine System - 31%, Female Genitalia - 15% |
| 1042 | 365070.1 | Nervous System - 83%, Female Genitalia - 17% |
| 1043 | 1383263.1 | Embryonic Structures - 55%, Skin - 27% |
| 1044 | 1383263.14 | widely distributed |
| 1045 | 406707.2 | Hemic and Immune System - 100% |
| 1046 | 406707.1 | Germ Cells - 94% |
| 1047 | 1051954.7 | Embryonic Structures - 18%, Female Genitalia - 16%, Endocrine System - 13% |
| 1048 | 102564.1 | Male Genitalia - 40%, Exocrine Glands - 40%, Digestive System - |
| 1049 | 233312.1 | Male Genitalia - 27%, Exocrine Glands - 27%, Respiratory System - 20%, Nervous System - 20% |
| 1050 | 335568. | Hemic and Immune System - 43%, Nervous System - 21%, Respiratory System - 21% |
| 1051 | 407739.1 | Exocrine Glands - 29%, Hemic and Immune System - 29%, Nervous System - 14%, Male Genitalia - 14%, Digestive System - |
| 1052 | 272273.1 | Nervous System - 67%, Digestive System - 33% |
| 1053 | 399133.9 | Exocrine Glands - 14% |
| 1054 | 246727.11 | Embryonic Structures - 18%, Connective Tissue - 14%, Female Genitalia - 14%, Male Genitalia - 14% |
| 1055 | 246727.17 | Sense Organs - 12% |
| 1056 | 230367.2 | Unclassified/Mixed - 18%, Germ Cells - 14%, Exocrine Glands - 13% |
| 1057 | 1383039.18 | Musculoskeletal System - 47%, Hemic and Immune System - 19%, Liver - 17% |
| 1058 | 1383039.17 | Sense Organs - 27% |
| 1059 | 27704.2 | Hemic and Immune System - 100% |
| 1060 | 346900.1 | Digestive System - 57%, Hemic and Immune System - 43% |
| 1061 | 249813.1 | Liver - 18%, Unclassified/Mixed - 17%, Nervous System - 13% |
| 1062 | 411357.1 | Cardiovascular System - 30%, Pancreas - 12%, Respiratory System - 11%, Exocrine Glands - 11%, Unclassified/Mixed - 11% |

TABLE 5-continued

| SEQ ID NO | Template ID | Tissue Distribution |
|---|---|---|
| 1063 | 68902.1 | Unclassified/Mixed - 63%, Musculoskeletal System - 12%, Digestive System - 12% |
| 1064 | 210133.1 | Pancreas - 18%, Connective Tissue - 14%, Female Genitalia - 13% |
| 1065 | 430665.1 | Connective Tissue - 24%, Liver - 18%, Cardiovascular System - 16% |
| 1066 | 902525.1 | Endocrine System - 27%, Exocrine Glands - 27%, Respiratory System - 20% |
| 1067 | 256841.1 | Germ Cells - 85% |
| 1068 | 206344.1 | Digestive System - 93% |
| 1069 | 107309.1 | Urinary Tract - 40%, Respiratory System - 30%, Male Genitalia - |
| 1070 | 1074024.1 | Pancreas - 56%, Respiratory System - 31%, Digestive System - 13% |
| 1071 | 233218.7 | Liver - 43%, Skin - 22%, Respiratory System - 13%, Digestive System - 13% |
| 1072 | 1092387.12 | Liver - 67%, Respiratory System - 19%, Hemic and Immune System - 11% |
| 1073 | 1092387.11 | Liver - 26%, Musculoskeletal System - 19%, Respiratory System - 11%, Unclassified/Mixed - 11% |
| 1074 | 366463.1 | Hemic and Immune System - 43%, Digestive System - 29%, Male Genitalia - 29% |
| 1075 | 304409.1 | Urinary Tract - 67%, Male Genitalia - 33% |
| 1076 | 1382920.38 | Hemic and Immune System - 14%, Connective Tissue - 12% |
| 1077 | 342365.1 | Urinary Tract - 54%, Hemic and Immune System - 31%, Male Genitalia - 15% |
| 1078 | 399210.1 | Urinary Tract - 36%, Hemic and Immune System - 27%, Female Genitalia - 18%, Male Genitalia - |
| 1079 | 1089210.1 | Liver - 95% |
| 1080 | 444619.9 | Liver - 31%, Endocrine System - 11% |
| 1081 | 312986.1 | Digestive System - 67%, Hemic and Immune System - 33% |
| 1082 | 462057.1 | Germ Cells - 19%, Skin - 16% |
| 1083 | 197902.12 | Embryonic Structures - 14%, Endocrine System - 13%, Unclassified/Mixed - 13% |
| 1084 | 997394.4 | Stomatognathic System - 28%, Digestive System - 17%, Embryonic Structures - 10% |
| 1086 | 2481150CD1 | |
| 1087 | 8198.1 | Embryonic Structures - 20%, Skin - 15%, Musculoskeletal System - |
| 1088 | 72297.2 | Embryonic Structures - 35%, Musculoskeletal System - 23%, Urinary Tract - 15% |
| 1089 | 994430.16 | Female Genitalia - 100% |
| 1090 | 189036.1 | Unclassified/Mixed - 56%, Cardiovascular System - 14% |
| 1091 | 221042.1 | Cardiovascular System - 12%, Male Genitalia - 11% |
| 1092 | 408398.1 | Sense Organs - 90% |
| 1093 | 985369.1 | Germ Cells - 15%, Male Genitalia - 11% |
| 1094 | 328796.1 | Urinary Tract - 44%, Hemic and Immune System - 33%, Male Genitalia - 22% |
| 1095 | 58804.1 | Male Genitalia - 100% |
| 1097 | 3505463CD1 | |
| 1098 | 197159.1 | Sense Organs - 11%, Hemic and Immune System - 11% |
| 1099 | 369928.1 | Female Genitalia - 100% |
| 1100 | 413466.6 | Musculoskeletal System - 22%, Female Genitalia - 12% |
| 1101 | 397295.1 | Connective Tissue - 80% |
| 1102 | 1330139.5 | Stomatognathic System - 15%, Cardiovascular System - 11% |
| 1103 | 977951.1 | Hemic and Immune System - 12%, Germ Cells - 10% |
| 1104 | 347316.1 | Nervous System - 50%, Cardiovascular System - 17%, Exocrine Glands- 17% |
| 1105 | 150288.3 | Embryonic Structures - 20%, Unclassified/Mixed - 18%, Male Genitalia - 13% |
| 1106 | 2455.1 | Nervous System - 76% |
| 1107 | 372647.1 | Nervous System - 100% |
| 1108 | 137710.1 | Respiratory System - 33%, Male Genitalia - 22%, Nervous System - 22%, Female Genitalia - 22% |
| 1109 | 407644.1 | Musculoskeletal System - 12%, Connective Tissue - 11%, Stomatognathic System - 11% |
| 1110 | 373516.1 | Musculoskeletal System - 72%, Respiratory System - 17%, Female Genitalia - 11% |
| 1111 | 241762.23 | Embryonic Structures - 34%, Cardiovascular System - 14%, Musculoskeletal System - 11%, Digestive System - 11% |
| 1112 | 1040914.1 | Male Genitalia - 57%, Respiratory System - 43% |
| 1113 | 358492.1 | Liver - 31%, Pancreas - 31%, Endocrine System - 14%, Digestive System - 14% |
| 1114 | 243924.12 | Liver - 90%, Hemic and Immune System - 10% |
| 1115 | 243924.13 | Female Genitalia - 20%, Liver - 17%, Urinary Tract - 17% |
| 1116 | 208075.1 | Hemic and Immune System - 29%, Unclassified/Mixed - 20%, Exocrine Glands - 14% |
| 1117 | 168955.1 | Sense Organs - 36%, Germ Cells - 36%, Connective Tissue - 19% |
| 1118 | 428508.1 | Connective Tissue - 100% |
| 1119 | 418070.1 | Pancreas - 72%, Urinary Tract - 16%, Nervous System - 12% |
| 1120 | 403994.5 | Female Genitalia - 50%, Nervous System - 25%, Hemic and Immune System - 25% |
| 1121 | 336726.1 | Unclassified/Mixed - 41%, Liver - 15%, Exocrine Glands - 13% |
| 1122 | 336726.1 | Germ Cells - 36%, Nervous System - 17%, Cardiovascular System - 11%, Unclassified/Mixed - 11% |
| 1123 | 410781.1 | Respiratory System - 31%, Connective Tissue - 21%, Pancreas - |
| 1124 | 347759.3 | Exocrine Glands - 15% |
| 1125 | 1252060.4 | Liver - 92% |
| 1126 | 209279.1 | Liver - 37%, Sense Organs - 16%, Pancreas - 11% |
| 1127 | 418391.2 | Connective Tissue - 44%, Nervous System - 44%, Female Genitalia - 13% |
| 1128 | 480630.21 | Hemic and Immune System - 33%, Unclassified/Mixed - 30%, Digestive System - 15%, Cardiovascular System - 15% |
| 1129 | 117799.1 | Liver - 51%, Connective Tissue - 20%, Male Genitalia - 11%, Digestive System - 11% |
| 1130 | 235194.15 | Liver - 69%, Hemic and Immune System - 23% |
| 1131 | 379400.1 | Nervous System - 100% |
| 1132 | 380433.1 | Male Genitalia - 29%, Female Genitalia - 29%, Digestive System - |
| 1133 | 140122.22 | Skin - 21%, Musculoskeletal System - 14%, Respiratory System - 13% |
| 1134 | 131931.1 | Urinary Tract - 80%, Nervous System - 20% |
| 1135 | 381058.1 | Unclassified/Mixed - 85%, Male Genitalia - 10% |
| 1136 | 403136.1 | Liver- 100% |

TABLE 5-continued

| SEQ ID NO | Template ID | Tissue Distribution |
|---|---|---|
| 1137 | 276647.1 | Respiratory System - 50%, Urinary Tract - 25%, Female Genitalia - 13%, Digestive System - 13% |
| 1138 | 191631.1 | Male Genitalia - 67%, Nervous System - 33% |
| 1139 | 887619.26 | widely distributed |
| 1140 | 980953.1 | Unclassified/Mixed - 41%, Skin - 23%, Connective Tissue - 11% |
| 1141 | 389859.1 | Cardiovascular System - 67%, Nervous System - 33% |
| 1142 | 217281.1 | Musculoskeletal System - 67%, Nervous System - 33% |
| 1143 | 32428.1 | Digestive System - 60%, Endocrine System - 40% |

TABLE 6

| Clone ID | Ave DE t/Mife | Range | mean DE t/Mife 1 µM, 1 hr | mean DE t/Mife 1 µM, 3 hr | mean DE t/Mife 1 µM, 6 hr | mean DE t/Mife 10 µM, 1 hr | mean DE t/Mife 10 µM, 3 hr | mean DE t/Mife 10 µM, 6 hr | mean DE t/Mife 100 µM, 1 hr | mean DE t/Mife 100 µM, 3 hr | mean DE t/Mife 100 µM, 6 hr | Cluster | GEM |
|---|---|---|---|---|---|---|---|---|---|---|---|---|---|
| 560115 | −1.45 | −2.67 to −0.04 | −1.69 | −1.90 | −0.04 | −1.54 | −2.11 | −0.57 | −1.14 | −2.67 | −1.43 | 0 | HGG 1 |
| 1315663 | −0.75 | −1.49 to −0.25 | −0.38 | −0.69 | −0.95 | −0.25 | −0.85 | −0.97 | −0.45 | −0.69 | −1.49 | 0 | HGG 1 |
| 1398105 | −0.76 | −1.59 to −0.26 | −0.63 | −0.56 | −0.70 | −0.26 | −0.57 | −1.06 | −0.51 | −0.98 | −1.59 | 0 | HGG 1 |
| 1607203 | −0.78 | −1.95 to −0.16 | −0.39 | −0.60 | −0.16 | −0.34 | −0.94 | −0.45 | −0.64 | −1.95 | −1.54 | 0 | HGG 1 |
| 1611445 | −0.93 | −1.58 to −0.41 | −0.60 | −1.05 | −0.41 | −0.99 | −1.09 | −0.65 | −0.70 | −1.58 | −1.26 | 0 | HGG 1 |
| 1619292 | −0.93 | −1.40 to −0.51 | −0.74 | −0.95 | −0.79 | −0.51 | −0.94 | −1.01 | −0.89 | −1.13 | −1.40 | 0 | HGG 1 |
| 1651008 | −0.71 | −1.40 to −0.48 | −0.72 | −0.74 | −0.48 | −0.48 | −0.54 | −0.55 | −0.66 | −1.40 | −0.85 | 0 | HGG 1 |
| 1781411 | −0.98 | −1.60 to −0.63 | −1.23 | −0.86 | −0.65 | −0.81 | −1.09 | −0.63 | −0.89 | −1.60 | −1.08 | 0 | HGG 1 |
| 1807155 | −0.58 | −1.56 to 0.01 | −0.57 | −1.00 | −0.17 | −0.13 | −1.05 | −0.22 | −0.01 | −1.56 | −0.48 | 0 | HGG 1 |
| 2026270 | −0.67 | −1.34 to −0.32 | −0.38 | −0.51 | −0.32 | −0.40 | −0.86 | −0.56 | −0.66 | −1.34 | −0.96 | 0 | HGG 1 |
| 2055867 | −0.84 | −1.99 to −0.29 | −0.50 | −1.35 | −0.32 | −0.29 | −1.56 | −0.34 | −0.31 | −1.99 | −0.88 | 0 | HGG 1 |
| 2890141 | −0.71 | −1.40 to −0.09 | −0.63 | −0.71 | −0.73 | −0.19 | −0.78 | −0.84 | −0.09 | −1.03 | −1.40 | 0 | HGG 1 |
| 2769888 | −1.29 | −1.94 to −0.72 | −0.92 | −1.50 | −1.07 | −0.77 | −1.73 | −1.30 | −0.72 | −1.94 | −1.65 | 0 | HGG 1 |
| 3397390 | −1.13 | −1.50 to −0.73 | −1.08 | −1.18 | −1.01 | −0.98 | −1.50 | −1.27 | −0.73 | −1.36 | −1.09 | 0 | HGG 1 |
| 3451645 | −0.74 | −1.44 to −0.14 | −0.69 | −0.84 | −0.44 | −0.36 | −0.94 | −0.62 | −0.14 | −1.18 | −1.44 | 0 | HGG 1 |
| 3715059 | −0.75 | −1.45 to −0.16 | −0.33 | −1.02 | −0.69 | −0.16 | −0.92 | −0.85 | −0.22 | −1.45 | −1.11 | 0 | HGG 1 |
| 4408943 | −0.96 | −2.01 to −0.16 | −0.82 | −1.23 | −0.16 | −0.68 | −1.40 | −0.40 | −0.55 | −2.01 | −1.43 | 0 | HGG 1 |
| 5047895 | −1.19 | −2.49 to −0.30 | −0.32 | −1.28 | −0.30 | −0.50 | −1.64 | −0.96 | −0.82 | −2.49 | −2.42 | 0 | HGG 1 |
| 5208013 | −0.76 | −1.34 to −0.26 | −0.66 | −0.82 | −0.66 | −0.43 | −0.80 | −0.70 | −0.26 | −1.16 | −1.34 | 0 | HGG 1 |
| 1308729 | 0.86 | 0.26 to 1.33 | 0.48 | 1.16 | 1.10 | 0.26 | 1.04 | 1.22 | 0.40 | 1.33 | 0.74 | 1 | HGG 1 |
| 2430750 | 0.60 | 0.16 to 1.52 | 0.33 | 0.25 | 0.16 | 0.47 | 0.44 | 0.34 | 1.52 | 0.75 | 1.11 | 1 | HGG 1 |
| 4721130 | 0.85 | 0.41 to 1.46 | 0.49 | 0.84 | 1.46 | 0.49 | 0.75 | 1.14 | 0.41 | 1.01 | 1.07 | 1 | HGG 1 |
| 4110976 | −0.17 | −1.56 to 0.12 | 0.00 | 0.00 | −1.56 | −0.03 | 0.00 | 0.00 | −0.06 | 0.00 | 0.12 | 2 | HGG 1 |
| 739461 | −0.22 | −1.98 to 0.00 | 0.00 | 0.00 | 0.00 | 0.00 | 0.00 | 0.00 | −1.98 | 0.00 | 0.00 | 2 | HGG 1 |
| 865145 | −0.23 | −1.57 to 0.10 | −1.57 | −0.16 | −0.05 | 0.03 | −0.27 | −0.02 | 0.10 | 0.08 | −0.16 | 2 | HGG 1 |
| 2515666 | 1.29 | 0.53 to 2.23 | 0.56 | 1.70 | 1.06 | 0.62 | 2.23 | 1.51 | 0.53 | 2.00 | 1.38 | 3 | HGG 1 |
| 4287327 | 1.26 | 0.21 to 1.95 | 0.76 | 1.84 | 1.14 | 0.77 | 1.80 | 1.37 | 0.21 | 1.95 | 1.47 | 3 | HGG 1 |
| 279898 | 1.40 | 0.38 to 2.18 | 0.79 | 1.81 | 1.68 | 0.50 | 1.91 | 1.64 | 0.38 | 2.18 | 1.70 | 3 | HGG 1 |
| 1911443 | −1.14 | −1.70 to −0.33 | −0.73 | −1.29 | −1.24 | −0.33 | −1.56 | −1.70 | | | | 0 | HGG 3 |
| 3120209 | −1.24 | −1.93 to −0.50 | −1.93 | −1.29 | −1.32 | −1.51 | −0.50 | −0.90 | | | | 0 | HGG 3 |
| 3135460 | −1.04 | −1.77 to −0.46 | −0.85 | −1.47 | −0.62 | −0.46 | −1.77 | −1.09 | | | | 0 | HGG 3 |
| 3778404 | −0.78 | −1.44 to −0.21 | −0.49 | −0.96 | −0.70 | −0.21 | −1.44 | −0.87 | | | | 0 | HGG 3 |
| 5426158 | −0.93 | −1.33 to −0.61 | −0.81 | −0.93 | −0.72 | −0.61 | −1.33 | −1.21 | | | | 0 | HGG 3 |
| 5427710 | −0.94 | −1.44 to −0.69 | −0.77 | −0.69 | −1.24 | −0.77 | −0.76 | −1.44 | | | | 0 | HGG 3 |
| 5293028 | −1.38 | −2.18 to 0.49 | 0.49 | −1.52 | −1.51 | −1.64 | −2.18 | −1.92 | | | | 1 | HGG 3 |
| 4543123 | −1.20 | −1.90 to 0.27 | 0.27 | −1.31 | −1.19 | −1.46 | −1.90 | −1.62 | | | | 1 | HGG 3 |
| 5166479 | −1.28 | −2.37 to −0.14 | −1.20 | −1.34 | −0.14 | −1.11 | −2.37 | −1.51 | | | | 1 | HGG 3 |

TABLE 7

| Clone ID | Ave DE t/prog | Range | mean DE t/prog 1 μM, 1 hr | mean DE t/prog 1 μM, 3 hr | mean DE t/prog 1 μM, 6 hr | mean DE t/prog 10 μM, 1 hr | mean DE t/prog 10 μM, 3 hr | mean DE t/prog 10 μM, 6 hr | mean DE t/prog 100 μM, 1 hr | mean DE t/prog 100 μM, 3 hr | mean DE t/prog 100 μM, 6 hr | Cluster | GEM |
|---|---|---|---|---|---|---|---|---|---|---|---|---|---|
| 2311213 | 1.08 | 0.76 to 1.61 | 0.76 | 1.40 | 1.31 | 1.61 | 1.17 | 0.93 | 0.89 | 0.85 | 0.81 | 0 | HGG 1 |
| 2313349 | 1.36 | 1.15 to 1.51 | 1.15 | 1.43 | 1.15 | 1.38 | 1.47 | 1.40 | 1.51 | 1.42 | 1.31 | 0 | HGG 1 |
| 3595618 | 1.21 | 0.90 to 1.38 | 0.90 | 1.37 | 1.03 | 1.29 | 1.26 | 1.24 | 1.38 | 1.25 | 1.12 | 0 | HGG 1 |
| 1342744 | 1.30 | 1.01 to 1.42 | 1.01 | 1.39 | 1.14 | 1.42 | 1.38 | 1.31 | 1.39 | 1.37 | 1.32 | 0 | HGG 1 |
| 139949 | 1.05 | 0.72 to 1.48 | 1.01 | 1.11 | 0.72 | 1.47 | 1.24 | 0.77 | 1.48 | 0.73 | 0.92 | 0 | HGG 1 |
| 2403438 | 1.32 | 0.93 to 1.66 | 1.21 | 1.66 | 1.54 | 1.47 | 1.50 | 1.28 | 1.30 | 0.97 | 0.93 | 0 | HGG 1 |
| 2445967 | 1.29 | 1.03 to 1.52 | 1.03 | 1.27 | 1.06 | 1.37 | 1.45 | 1.44 | 1.52 | 1.22 | 1.22 | 0 | HGG 1 |
| 1459743 | 1.18 | 0.96 to 1.50 | 1.02 | 1.22 | 0.99 | 1.44 | 1.50 | 1.29 | 1.22 | 0.96 | 0.97 | 0 | HGG 1 |
| 2494284 | 1.27 | 0.68 to 1.75 | 1.19 | 0.92 | 0.68 | 1.75 | 1.60 | 1.61 | 1.27 | 1.16 | 1.29 | 0 | HGG 1 |
| 1521272 | 1.04 | 0.63 to 1.34 | 0.63 | 0.91 | 0.68 | 1.34 | 1.27 | 1.26 | 1.23 | 0.88 | 1.19 | 0 | HGG 1 |
| 3687719 | 1.37 | 1.06 to 1.60 | 1.06 | 1.34 | 1.08 | 1.45 | 1.46 | 1.53 | 1.60 | 1.41 | 1.37 | 0 | HGG 1 |
| 371201 | 1.17 | 0.91 to 1.44 | 0.91 | 1.18 | 1.04 | 1.44 | 1.24 | 1.05 | 1.10 | 1.35 | 1.26 | 0 | HGG 1 |
| 3821432 | 1.17 | 0.87 to 1.39 | 0.93 | 1.08 | 0.87 | 1.32 | 1.39 | 1.34 | 1.34 | 1.15 | 1.08 | 0 | HGG 1 |
| 2516950 | 1.46 | 1.18 to 1.65 | 1.18 | 1.56 | 1.42 | 1.64 | 1.65 | 1.52 | 1.57 | 1.32 | 1.29 | 0 | HGG 1 |
| 1684617 | 1.42 | 0.93 to 1.72 | 1.65 | 1.60 | 1.28 | 1.68 | 1.72 | 1.42 | 1.31 | 1.16 | 0.93 | 0 | HGG 1 |
| 4092112 | 1.09 | 0.78 to 1.35 | 0.98 | 1.11 | 0.96 | 1.32 | 1.35 | 1.27 | 1.20 | 0.82 | 0.78 | 0 | HGG 1 |
| 1756875 | 1.28 | 0.88 to 1.51 | 1.42 | 1.51 | 1.42 | 1.50 | 1.48 | 1.18 | 1.18 | 0.96 | 0.88 | 0 | HGG 1 |
| 4286760 | 1.28 | 1.07 to 1.55 | 1.07 | 1.55 | 1.40 | 1.25 | 1.33 | 1.36 | 1.17 | 1.17 | 1.25 | 0 | HGG 1 |
| 2697275 | 1.18 | 0.72 to 1.36 | 0.72 | 1.36 | 1.04 | 1.33 | 1.27 | 1.26 | 1.25 | 1.18 | 1.21 | 0 | HGG 1 |
| 4978708 | 1.28 | 0.91 to 1.39 | 0.91 | 1.35 | 1.14 | 1.31 | 1.32 | 1.39 | 1.37 | 1.36 | 1.34 | 0 | HGG 1 |
| 2756333 | 1.17 | 0.92 to 1.36 | 1.12 | 1.30 | 1.10 | 1.36 | 1.20 | 1.07 | 1.13 | 1.28 | 0.92 | 0 | HGG 1 |
| 5046235 | 1.25 | 0.99 to 1.56 | 1.15 | 1.22 | 0.99 | 1.56 | 1.21 | 1.21 | 1.17 | 1.21 | 1.48 | 0 | HGG 1 |
| 1956982 | 1.43 | 0.85 to 1.77 | 0.85 | 1.48 | 1.70 | 1.41 | 1.77 | 1.69 | 1.71 | 1.03 | 1.24 | 0 | HGG 1 |
| 671717 | 1.25 | 1.04 to 1.52 | 1.04 | 1.52 | 1.22 | 1.39 | 1.37 | 1.35 | 1.11 | 1.13 | 1.16 | 0 | HGG 1 |
| 2778441 | 1.11 | 0.79 to 1.38 | 0.79 | 1.02 | 0.84 | 1.26 | 1.23 | 1.29 | 1.38 | 1.07 | 1.09 | 0 | HGG 1 |
| 279898 | 1.52 | 0.53 to 2.97 | 0.53 | 1.66 | 1.91 | 0.64 | 1.73 | 1.83 | 0.59 | 1.79 | 2.97 | 0 | HGG 1 |
| 2823767 | 1.37 | 0.96 to 1.73 | 1.34 | 1.40 | 1.25 | 1.61 | 1.73 | 1.46 | 1.54 | 1.08 | 0.96 | 0 | HGG 1 |
| 2830240 | 0.97 | 0.66 to 1.33 | 0.66 | 1.03 | 1.04 | 0.96 | 0.94 | 1.02 | 0.78 | 1.00 | 1.33 | 0 | HGG 1 |
| 2833342 | 1.25 | 0.98 to 1.41 | 0.98 | 1.37 | 1.05 | 1.30 | 1.41 | 1.28 | 1.35 | 1.27 | 1.26 | 0 | HGG 1 |
| 2120743 | 1.25 | 0.83 to 1.58 | 1.03 | 1.58 | 1.32 | 1.45 | 1.56 | 1.37 | 1.10 | 0.97 | 0.83 | 0 | HGG 1 |
| 305751 | 1.33 | 1.08 to 1.63 | 1.08 | 1.33 | 1.18 | 1.63 | 1.48 | 1.29 | 1.21 | 1.40 | 1.41 | 0 | HGG 1 |
| 3391835 | 1.38 | 0.57 to 2.26 | 1.20 | 1.67 | 1.65 | 2.26 | 1.54 | 1.65 | 1.06 | 0.57 | 0.84 | 0 | HGG 1 |
| 2055814 | −0.99 | −1.44 to −0.68 | −0.78 | −1.12 | −1.31 | −0.72 | −1.16 | −1.44 | −0.68 | −0.69 | −1.01 | 1 | HGG 1 |
| 2055867 | −0.82 | −1.42 to 0.08 | −0.35 | −1.03 | −1.40 | −0.18 | −1.42 | −1.42 | 0.08 | −0.58 | −1.11 | 1 | HGG 1 |
| 3126622 | −0.99 | −1.33 to −0.76 | −0.79 | −0.96 | −1.18 | −0.92 | −1.11 | −1.33 | −0.90 | −0.76 | −0.98 | 1 | HGG 1 |
| 2839946 | −1.15 | −1.47 to −0.84 | −1.28 | −0.94 | −1.17 | −1.29 | −1.47 | −1.44 | −1.05 | −0.85 | −0.84 | 1 | HGG 1 |
| 2132607 | −1.10 | −1.44 to −0.74 | −0.89 | −0.98 | −1.05 | −1.28 | −1.34 | −1.44 | −1.13 | −0.74 | −1.07 | 1 | HGG 1 |
| 3397390 | −1.13 | −1.58 to −0.73 | −1.02 | −1.11 | −1.21 | −0.91 | −1.43 | −1.58 | −1.01 | −0.73 | −1.17 | 1 | HGG 1 |
| 2382190 | −0.83 | −1.33 to 0.00 | −0.61 | −0.82 | −1.00 | −0.83 | −1.04 | −1.33 | −0.87 | 0.00 | −0.98 | 1 | HGG 1 |
| 2495131 | −1.04 | −1.42 to −0.58 | −1.01 | −1.11 | −1.27 | −0.92 | −1.25 | −1.42 | −0.90 | −0.58 | −0.90 | 1 | HGG 1 |
| 3408804 | −1.16 | −1.56 to −0.83 | −1.56 | −1.12 | −1.14 | −1.20 | −1.23 | −1.24 | −1.03 | −1.09 | −0.83 | 1 | HGG 1 |
| 167081 | −1.12 | −1.57 to −0.53 | −1.05 | −1.18 | −1.57 | −0.53 | −1.42 | −1.39 | −1.03 | −0.70 | −1.18 | 1 | HGG 1 |
| 3451645 | −0.91 | −1.33 to −0.57 | −0.73 | −0.83 | −1.14 | −0.79 | −1.10 | −1.33 | −0.57 | −0.75 | −0.91 | 1 | HGG 1 |
| 1807155 | −0.91 | −1.40 to −0.54 | −0.65 | −0.68 | −1.08 | −0.83 | −1.25 | −1.40 | −0.54 | −0.70 | −1.08 | 1 | HGG 1 |
| 41479 | −0.95 | −1.35 to −0.64 | −0.64 | −0.92 | −1.07 | −0.82 | −1.11 | −1.35 | −0.71 | −0.84 | −1.08 | 1 | HGG 1 |
| 4246966 | −1.04 | −1.45 to −0.70 | −1.06 | −0.70 | −0.78 | −1.10 | −1.15 | −0.97 | −1.11 | −1.01 | −1.45 | 1 | HGG 1 |
| 5045593 | −1.02 | −1.41 to −0.76 | −0.95 | −0.92 | −1.10 | −0.76 | −1.19 | −1.41 | −0.90 | −0.85 | −1.07 | 1 | HGG 1 |
| 2767579 | −1.14 | −1.40 to −0.91 | −0.91 | −1.21 | −1.33 | −1.07 | −1.26 | −1.40 | −1.00 | −0.91 | −1.19 | 1 | HGG 1 |
| 2769888 | −1.11 | −1.73 to −0.59 | −0.91 | −1.13 | −1.67 | −0.67 | −1.34 | −1.73 | −0.59 | −0.88 | −1.06 | 1 | HGG 1 |
| 2047730 | −1.15 | −1.47 to −0.91 | −0.91 | −0.94 | −1.05 | −1.30 | −1.47 | −1.36 | −1.03 | −1.03 | −1.27 | 1 | HGG 1 |
| 2506973 | −1.59 | −1.92 to −1.28 | −1.39 | −1.28 | −1.43 | −1.81 | −1.83 | −1.92 | −1.67 | −1.33 | −1.68 | 2 | HGG 1 |
| 3001212 | −1.44 | −1.70 to −1.18 | −1.28 | −1.36 | −1.33 | −1.60 | −1.55 | −1.70 | −1.40 | −1.18 | −1.56 | 2 | HGG 1 |
| 3975209 | −1.27 | −1.67 to −1.04 | −1.12 | −1.11 | −1.11 | −1.54 | −1.27 | −1.67 | −1.41 | −1.04 | −1.20 | 2 | HGG 1 |
| 1441245 | −1.25 | −1.50 to −1.09 | −1.24 | −1.24 | −1.12 | −1.50 | −1.42 | −1.23 | −1.14 | −1.09 | −1.27 | 2 | HGG 1 |
| 2623304 | −1.30 | −1.59 to −0.99 | −1.25 | −1.05 | −1.36 | −1.42 | −1.56 | −1.59 | −1.17 | −0.99 | −1.34 | 2 | HGG 1 |
| 3679667 | −1.39 | −1.61 to −1.24 | −1.61 | −1.43 | −1.39 | −1.32 | −1.50 | −1.44 | −1.30 | −1.24 | −1.27 | 2 | HGG 1 |
| 891072 | −1.30 | −1.47 to −1.06 | −1.06 | −1.26 | −1.34 | −1.24 | −1.45 | −1.47 | −1.28 | −1.24 | −1.32 | 2 | HGG 1 |
| 1619292 | −1.28 | −1.50 to −0.89 | −0.89 | −1.28 | −1.45 | −1.27 | −1.31 | −1.48 | −1.15 | −1.17 | −1.50 | 2 | HGG 1 |
| 5291518 | −1.35 | −1.66 to −0.99 | −1.27 | −1.23 | −1.19 | −1.50 | −1.66 | −1.60 | −1.44 | −0.99 | −1.25 | 2 | HGG 1 |
| 1740474 | −1.35 | −1.62 to −1.03 | −1.03 | −1.20 | −1.15 | −1.49 | −1.52 | −1.62 | −1.34 | −1.33 | −1.46 | 2 | HGG 1 |
| 1868536 | −1.36 | −1.65 to −1.15 | −1.15 | −1.20 | −1.27 | −1.33 | −1.51 | −1.65 | −1.51 | −1.31 | −1.32 | 2 | HGG 1 |
| 1876456 | −1.33 | −1.54 to −1.06 | −1.06 | −1.25 | −1.17 | −1.54 | −1.47 | −1.40 | −1.44 | −1.19 | −1.47 | 2 | HGG 1 |
| 1890576 | −1.62 | −1.83 to −1.40 | −1.40 | −1.54 | −1.60 | −1.67 | −1.56 | −1.74 | −1.65 | −1.83 | −1.64 | 2 | HGG 1 |
| 1910401 | −1.33 | −1.57 to −1.13 | −1.35 | −1.13 | −1.22 | −1.38 | −1.57 | −1.52 | −1.39 | −1.18 | −1.23 | 2 | HGG 1 |
| 2042056 | −1.66 | −2.17 to −0.42 | −2.14 | −1.81 | −1.52 | −2.17 | −1.94 | −1.53 | −1.93 | −1.44 | −0.42 | 2 | HGG 1 |
| 2061528 | −1.34 | −1.58 to −1.07 | −1.23 | −1.38 | −1.24 | −1.58 | −1.49 | −1.31 | −1.36 | −1.07 | −1.39 | 2 | HGG 1 |
| 4698018 | −1.23 | −1.38 to −1.06 | −1.23 | −1.08 | −1.06 | −1.32 | −1.36 | −1.38 | −1.15 | −1.16 | −1.36 | 2 | HGG 1 |
| 5047895 | −1.62 | −1.83 to −1.44 | −1.77 | −1.43 | −1.71 | −1.51 | −1.72 | −1.83 | −1.53 | −1.44 | −1.65 | 2 | HGG 1 |
| 5509134 | 1.85 | 1.29 to 2.19 | 1.43 | 2.13 | 2.09 | 2.18 | 2.10 | 1.95 | 2.19 | 1.29 | 1.32 | 3 | HGG 1 |
| 617587 | 1.59 | 1.08 to 2.09 | 1.66 | 1.74 | 1.21 | 2.09 | 1.96 | 1.78 | 1.67 | 1.10 | 1.08 | 3 | HGG 1 |
| 1320685 | 1.68 | 1.30 to 2.04 | 1.47 | 1.48 | 1.30 | 1.95 | 1.90 | 1.85 | 2.04 | 1.44 | 1.69 | 3 | HGG 1 |
| 1457424 | 2.11 | 1.73 to 2.53 | 1.73 | 2.07 | 1.89 | 2.20 | 2.39 | 2.53 | 2.29 | 1.90 | 1.99 | 3 | HGG 1 |
| 3068809 | 1.97 | 1.49 to 2.15 | 1.49 | 2.15 | 1.85 | 2.06 | 2.04 | 2.00 | 2.11 | 2.08 | 1.97 | 3 | HGG 1 |

TABLE 7-continued

| Clone ID | Ave DE t/prog | Range | mean DE t/prog 1 μM, 1 hr | mean DE t/prog 1 μM, 3 hr | mean DE t/prog 1 μM, 6 hr | mean DE t/prog 10 μM, 1 hr | mean DE t/prog 10 μM, 3 hr | mean DE t/prog 10 μM, 6 hr | mean DE t/prog 100 μM, 1 hr | mean DE t/prog 100 μM, 3 hr | mean DE t/prog 100 μM, 6 hr | Cluster | GEM |
|---|---|---|---|---|---|---|---|---|---|---|---|---|---|
| 2110430 | 1.61 | 1.22 to 2.09 | 1.29 | 1.51 | 1.22 | 2.09 | 1.97 | 2.00 | 1.67 | 1.23 | 1.56 | 3 | HGG 1 |
| 2511277 | 1.67 | 1.26 to 1.89 | 1.26 | 1.80 | 1.57 | 1.62 | 1.76 | 1.66 | 1.76 | 1.89 | 1.69 | 3 | HGG 1 |
| 2520894 | 1.93 | 1.49 to 2.23 | 2.00 | 2.17 | 1.92 | 2.23 | 2.16 | 1.86 | 1.93 | 1.66 | 1.49 | 3 | HGG 1 |
| 2956444 | 1.57 | 1.22 to 1.77 | 1.59 | 1.58 | 1.51 | 1.65 | 1.77 | 1.56 | 1.77 | 1.49 | 1.22 | 3 | HGG 1 |
| 3792988 | 1.85 | 1.48 to 2.17 | 1.97 | 2.17 | 1.87 | 2.06 | 2.05 | 1.84 | 1.59 | 1.57 | 1.48 | 3 | HGG 1 |
| 3606046 | 1.52 | 1.15 to 1.82 | 1.47 | 1.75 | 1.47 | 1.65 | 1.82 | 1.54 | 1.53 | 1.35 | 1.15 | 3 | HGG 1 |
| 459372 | 1.87 | 1.77 to 2.03 | 1.77 | 1.91 | 1.83 | 2.03 | 1.93 | 1.79 | 1.85 | 1.86 | 1.84 | 3 | HGG 1 |
| 548114 | 1.73 | 1.51 to 1.90 | 1.82 | 1.90 | 1.51 | 1.87 | 1.79 | 1.55 | 1.67 | 1.79 | 1.64 | 3 | HGG 1 |
| 5501676 | 1.86 | 0.36 to 2.55 | 1.85 | 2.43 | 2.02 | 2.15 | 2.55 | 2.36 | 1.97 | 1.06 | 0.36 | 3 | HGG 1 |
| 3031022 | −1.93 | −2.59 to −1.43 | −1.43 | −2.59 | −1.92 | −1.78 | −2.08 | −2.29 | −1.62 | −1.72 | −1.94 | 4 | HGG 1 |
| 1596220 | −1.69 | −1.99 to −1.49 | −1.49 | −1.50 | −1.52 | −1.99 | −1.85 | −1.72 | −1.68 | −1.61 | −1.82 | 4 | HGG 1 |
| 4408943 | −1.85 | −2.36 to −1.47 | −1.75 | −1.47 | −1.78 | −1.88 | −2.22 | −2.36 | −1.68 | −1.58 | −1.90 | 4 | HGG 1 |
| 560115 | −2.08 | −2.78 to −1.54 | −2.16 | −2.10 | −1.95 | −2.11 | −2.07 | −2.12 | −1.54 | −1.85 | −2.08 | 4 | HGG 1 |
| 2886955 | −1.70 | −2.00 to −1.42 | −1.42 | −1.64 | −1.63 | −1.84 | −2.00 | −1.92 | −1.68 | −1.54 | −1.63 | 4 | HGG 1 |
| 5541828 | −1.76 | −2.07 to −1.46 | −1.51 | −1.68 | −1.82 | −1.95 | −2.07 | −2.02 | −1.56 | −1.46 | −1.76 | 4 | HGG 1 |
| 2912637 | −2.08 | −2.37 to −1.73 | −1.73 | −2.16 | −2.08 | −2.09 | −2.26 | −2.28 | −1.78 | −1.98 | −2.37 | 4 | HGG 1 |
| 4549259 | 2.93 | 2.51 to 3.24 | 2.69 | 2.86 | 2.70 | 3.14 | 3.24 | 3.08 | 3.19 | 2.51 | 3.00 | 5 | HGG 1 |
| 2755836 | 2.78 | 2.03 to 3.33 | 2.94 | 2.90 | 3.33 | 3.04 | 2.91 | 2.84 | 2.74 | 2.03 | 2.25 | 5 | HGG 1 |
| 2818476 | 2.46 | 1.91 to 2.82 | 2.53 | 2.82 | 2.58 | 2.78 | 2.68 | 2.30 | 2.50 | 1.91 | 2.00 | 5 | HGG 1 |
| 1630990 | 2.35 | 1.92 to 2.80 | 2.23 | 2.80 | 2.56 | 2.41 | 2.53 | 2.30 | 2.39 | 1.92 | 1.97 | 5 | HGG 1 |
| 4287327 | 2.26 | 1.90 to 2.48 | 2.23 | 2.24 | 1.90 | 2.23 | 2.48 | 1.93 | 2.44 | 2.42 | 2.45 | 5 | HGG 1 |
| 1299246 | 0.64 | 0.09 to 1.65 | 0.32 | 0.34 | 0.75 | 0.09 | 0.82 | 0.96 | 0.21 | 0.67 | 1.65 | 6 | HGG 1 |
| 4858420 | 0.74 | 0.18 to 1.76 | 0.37 | 0.55 | 0.63 | 0.27 | 1.06 | 1.14 | 0.18 | 0.75 | 1.76 | 6 | HGG 1 |
| 2847188 | 0.26 | 0.00 to 2.37 | 2.37 | 0.00 | 0.00 | 0.00 | 0.00 | 0.00 | 0.00 | 0.00 | 0.00 | 6 | HGG 1 |
| 1513566 | 0.63 | 0.18 to 1.36 | 0.40 | 0.45 | 0.75 | 0.18 | 0.79 | 0.76 | 0.25 | 0.73 | 1.36 | 6 | HGG 1 |
| 1308729 | 0.71 | 0.20 to 1.59 | 0.40 | 0.38 | 0.77 | 0.20 | 0.97 | 1.23 | 0.24 | 0.63 | 1.59 | 6 | HGG 1 |
| 2233219 | −0.31 | −1.63 to 0.00 | −0.28 | 0.00 | −1.63 | −0.14 | −0.42 | −0.33 | 0.00 | 0.00 | 0.00 | 7 | HGG 1 |
| 3001817 | −0.17 | −1.98 to 0.25 | 0.00 | −1.98 | 0.25 | 0.19 | 0.00 | −0.03 | 0.00 | 0.00 | 0.00 | 7 | HGG 1 |
| 531842 | −0.26 | −2.41 to 0.08 | −2.41 | 0.00 | 0.00 | 0.08 | 0.00 | −0.01 | 0.00 | 0.00 | 0.00 | 7 | HGG 1 |
| 481402 | 0.06 | −1.44 to 0.47 | 0.24 | −1.44 | 0.23 | 0.40 | 0.47 | 0.47 | 0.24 | −0.15 | 0.12 | 7 | HGG 1 |
| 2499905 | 1.24 | 1.10 to 1.51 | 1.19 | 1.51 | 1.16 | 1.11 | 1.39 | 1.11 | 1.46 | 1.10 | 1.12 | 0 | HGG 2 |
| 1988540 | 1.43 | 1.02 to 1.80 | 1.44 | 1.80 | 1.25 | 1.64 | 1.65 | 1.61 | 1.28 | 1.17 | 1.02 | 0 | HGG 2 |
| 2394990 | 1.26 | 0.62 to 1.56 | 0.62 | 1.36 | 1.22 | 1.34 | 1.56 | 1.19 | 1.19 | 1.46 | 1.40 | 0 | HGG 2 |
| 1337924 | 0.79 | 0.32 to 1.42 | 0.32 | 1.42 | 0.75 | 0.72 | 0.82 | 0.62 | 0.71 | 0.99 | 0.79 | 0 | HGG 2 |
| 1407125 | 1.41 | 1.20 to 1.56 | 1.39 | 1.56 | 1.32 | 1.36 | 1.55 | 1.31 | 1.47 | 1.48 | 1.20 | 0 | HGG 2 |
| 1487428 | 1.23 | 0.65 to 1.54 | 0.65 | 1.37 | 1.23 | 1.28 | 1.24 | 1.18 | 1.25 | 1.54 | 1.35 | 0 | HGG 2 |
| 2018315 | 1.62 | 1.44 to 1.85 | 1.47 | 1.85 | 1.65 | 1.50 | 1.77 | 1.44 | 1.49 | 1.77 | 1.60 | 0 | HGG 2 |
| 2021989 | 1.35 | 1.01 to 1.70 | 1.19 | 1.48 | 1.27 | 1.32 | 1.31 | 1.01 | 1.40 | 1.70 | 1.48 | 0 | HGG 2 |
| 960604 | 1.28 | 0.70 to 1.60 | 1.35 | 1.52 | 1.60 | 1.43 | 1.32 | 1.46 | 0.70 | 1.05 | 1.06 | 0 | HGG 2 |
| 3206352 | 1.41 | 1.14 to 1.65 | 1.34 | 1.65 | 1.39 | 1.43 | 1.53 | 1.39 | 1.14 | 1.42 | 1.44 | 0 | HGG 2 |
| 1841901 | 0.95 | 0.42 to 1.34 | 0.42 | 1.34 | 0.93 | 0.79 | 1.05 | 0.89 | 0.97 | 1.17 | 0.97 | 0 | HGG 2 |
| 1926934 | 1.24 | 0.00 to 1.81 | 1.55 | 0.00 | 1.79 | 1.81 | 1.67 | 1.56 | 1.42 | 0.00 | 1.34 | 0 | HGG 2 |
| 2226309 | 1.57 | 0.00 to 2.35 | 1.74 | 2.35 | 2.05 | 1.54 | 1.72 | 1.69 | 1.55 | 0.00 | 1.44 | 0 | HGG 2 |
| 2837006 | 1.40 | 1.18 to 1.68 | 1.39 | 1.68 | 1.46 | 1.41 | 1.46 | 1.18 | 1.43 | 1.19 | 1.38 | 0 | HGG 2 |
| 1303862 | 1.69 | 0.00 to 2.48 | 1.73 | 0.00 | 2.12 | 2.48 | 2.32 | 2.42 | 1.01 | 1.99 | 1.17 | 1 | HGG 2 |
| 1316801 | 2.26 | 1.89 to 2.68 | 2.48 | 2.68 | 2.38 | 2.37 | 2.30 | 1.97 | 2.15 | 1.89 | 2.15 | 1 | HGG 2 |
| 1326255 | 2.56 | 1.43 to 3.48 | 2.28 | 2.47 | 2.36 | 3.05 | 3.43 | 3.48 | 2.43 | 2.12 | 1.43 | 1 | HGG 2 |
| 626471 | 1.81 | 1.56 to 2.09 | 1.69 | 1.98 | 1.88 | 1.78 | 1.57 | 1.56 | 1.90 | 1.85 | 2.09 | 1 | HGG 2 |
| 660142 | 2.89 | 2.51 to 3.20 | 2.97 | 3.20 | 3.02 | 2.86 | 2.84 | 2.51 | 2.69 | 2.88 | 3.02 | 1 | HGG 2 |
| 1961617 | 2.08 | 1.64 to 2.53 | 1.90 | 2.53 | 2.35 | 2.02 | 2.34 | 2.00 | 1.64 | 2.19 | 1.76 | 1 | HGG 2 |
| 2124056 | 2.22 | 2.03 to 2.43 | 2.19 | 2.25 | 2.10 | 2.43 | 2.43 | 2.33 | 2.16 | 2.03 | 2.03 | 1 | HGG 2 |
| 2234266 | 2.28 | 1.94 to 2.68 | 2.09 | 2.68 | 2.34 | 2.31 | 2.58 | 2.26 | 1.94 | 2.18 | 2.14 | 1 | HGG 2 |
| 2544622 | 2.22 | 1.54 to 2.59 | 2.15 | 2.59 | 2.32 | 2.48 | 2.40 | 2.45 | 1.54 | 2.27 | 1.78 | 1 | HGG 2 |
| 1616048 | −0.98 | −1.39 to −0.45 | −1.09 | −1.10 | −1.21 | −0.96 | −1.39 | −1.23 | −0.45 | −0.84 | −0.60 | 2 | HGG 2 |
| 1753283 | −1.28 | −1.55 to −1.01 | −1.29 | −1.12 | −1.23 | −1.47 | −1.55 | −1.42 | −1.01 | −1.28 | −1.16 | 2 | HGG 2 |
| 2469891 | −0.93 | −1.33 to −0.46 | −0.46 | −1.05 | −0.86 | −0.83 | −1.25 | −1.33 | −0.88 | −0.85 | −0.89 | 2 | HGG 2 |
| 2655279 | −1.03 | −1.33 to −0.78 | −0.78 | −1.21 | −1.16 | −0.92 | −1.14 | −1.33 | −0.85 | −0.88 | −1.00 | 2 | HGG 2 |
| 2703122 | −1.41 | −1.74 to −1.09 | −1.09 | −1.58 | −1.37 | −1.27 | −1.72 | −1.74 | −1.26 | −1.31 | −1.30 | 2 | HGG 2 |
| 2794866 | −0.98 | −1.40 to −0.50 | −0.79 | −0.96 | −0.97 | −0.98 | −1.10 | −1.40 | −0.50 | −1.03 | −1.05 | 2 | HGG 2 |
| 3100048 | −0.87 | −1.35 to 0.03 | −0.78 | −1.12 | −1.35 | −0.12 | −1.26 | −1.35 | 0.03 | −1.03 | −0.87 | 2 | HGG 2 |
| 2253868 | −1.14 | −1.44 to −0.87 | −1.01 | −1.17 | −0.87 | −1.15 | −1.21 | −0.99 | −1.13 | −1.24 | −1.44 | 2 | HGG 2 |
| 1988774 | −1.22 | −1.76 to −0.51 | −0.75 | −1.71 | −1.45 | −0.75 | −1.69 | −1.76 | −0.51 | −1.20 | −1.19 | 2 | HGG 2 |
| 1981929 | 0.24 | 0.00 to 1.84 | 0.00 | 0.00 | 1.84 | 0.00 | 0.00 | 0.00 | 0.29 | 0.00 | 0.00 | 3 | HGG 2 |
| 1986919 | 0.65 | 0.00 to 1.43 | 0.85 | 0.00 | 0.00 | 0.73 | 1.06 | 0.84 | 0.91 | 0.00 | 0.43 | 3 | HGG 2 |
| 1820882 | 0.26 | 0.00 to 1.33 | 1.33 | 0.00 | 0.00 | 0.00 | 0.00 | 0.00 | 0.99 | 0.00 | 0.00 | 3 | HGG 2 |
| 3876612 | 0.26 | 0.00 to 1.46 | 0.87 | 0.00 | 0.00 | 0.00 | 0.00 | 0.00 | 0.00 | 0.00 | 1.46 | 3 | HGG 2 |
| 2246915 | 0.83 | 0.00 to 1.78 | 1.40 | 0.00 | 0.00 | 0.00 | 1.31 | 1.38 | 1.78 | 0.00 | 1.60 | 3 | HGG 2 |
| 2579572 | 0.20 | 0.00 to 1.45 | 0.37 | 0.00 | 0.00 | 0.00 | 0.00 | 0.00 | 1.45 | 0.00 | 0.00 | 3 | HGG 2 |
| 1816768 | 0.28 | 0.00 to 1.85 | 1.85 | 0.00 | 0.00 | 0.00 | 0.00 | 0.00 | 0.71 | 0.00 | 0.00 | 3 | HGG 2 |
| | | 0.00 to 0.00 | | | | | | | | | | | HGG 2 |
| 2828647 | −0.14 | −1.53 to 0.28 | 0.28 | 0.00 | 0.00 | 0.00 | 0.00 | 0.00 | −1.53 | 0.00 | 0.00 | 4 | HGG 2 |
| 3136307 | −0.28 | −1.45 to 0.23 | 0.23 | −0.29 | −0.25 | 0.16 | −0.18 | −0.17 | −1.45 | −0.18 | −0.33 | 4 | HGG 2 |
| 2918279 | −0.21 | −2.04 to 0.15 | 0.15 | 0.00 | 0.00 | 0.00 | 0.00 | 0.00 | −2.04 | 0.00 | 0.00 | 4 | HGG 2 |

TABLE 7-continued

| Clone ID | Ave DE t/prog | Range | mean DE t/prog 1 μM, 1 hr | mean DE t/prog 1 μM, 3 hr | mean DE t/prog 1 μM, 6 hr | mean DE t/prog 10 μM, 1 hr | mean DE t/prog 10 μM, 3 hr | mean DE t/prog 10 μM, 6 hr | mean DE t/prog 100 μM, 1 hr | mean DE t/prog 100 μM, 3 hr | mean DE t/prog 100 μM, 6 hr | Cluster | GEM |
|---|---|---|---|---|---|---|---|---|---|---|---|---|---|
| 3714088 | −0.20 | −2.13 to 0.32 | 0.32 | 0.00 | 0.00 | 0.00 | 0.00 | 0.00 | −2.13 | 0.00 | 0.00 | 4 | HGG 2 |
| 1560380 | 1.25 | 1.06 to 1.55 | 1.06 | 1.44 | 1.22 | 1.18 | 1.22 | 1.17 | 1.55 | 1.32 | 1.08 | 0 | HGG 3 |
| 1786554 | 1.20 | 1.03 to 1.36 | 1.03 | 1.36 | 1.21 | 1.19 | 1.18 | 1.17 | 1.11 | 1.33 | 1.24 | 0 | HGG 3 |
| 3974247 | 1.02 | 0.83 to 1.39 | 0.83 | 1.15 | 0.93 | 0.95 | 0.92 | 0.93 | 1.00 | 1.39 | 1.12 | 0 | HGG 3 |
| 2195427 | 1.28 | 0.99 to 1.46 | 1.25 | 1.28 | 1.30 | 1.45 | 1.44 | 1.46 | 1.36 | 1.02 | 0.99 | 0 | HGG 3 |
| 2343348 | 1.47 | 1.21 to 1.61 | 1.21 | 1.61 | 1.48 | 1.44 | 1.59 | 1.46 | 1.45 | 1.47 | 1.48 | 0 | HGG 3 |
| 3158828 | 1.28 | 1.01 to 1.62 | 1.17 | 1.62 | 1.31 | 1.26 | 1.34 | 1.22 | 1.01 | 1.26 | 1.33 | 0 | HGG 3 |
| 2545486 | 1.53 | 0.82 to 1.96 | 0.82 | 1.96 | 1.32 | 1.39 | 1.54 | 1.84 | 1.23 | 1.80 | 1.84 | 0 | HGG 3 |
| 2972013 | 1.28 | 0.96 to 1.46 | 0.96 | 1.46 | 1.23 | 1.25 | 1.28 | 1.33 | 1.23 | 1.38 | 1.40 | 0 | HGG 3 |
| 4508879 | 0.80 | −0.08 to 1.53 | 0.94 | 1.53 | 1.13 | 0.79 | 0.99 | 1.12 | 0.41 | 0.32 | −0.08 | 0 | HGG 3 |
| 4912315 | 1.21 | 0.98 to 1.41 | 1.13 | 1.41 | 0.98 | 1.02 | 1.18 | 1.34 | 1.17 | 1.39 | 1.27 | 0 | HGG 3 |
| 3495173 | 1.14 | 0.90 to 1.34 | 0.90 | 1.34 | 1.14 | 1.05 | 1.11 | 1.14 | 1.11 | 1.24 | 1.29 | 0 | HGG 3 |
| 3528232 | 0.99 | 0.00 to 1.32 | 0.74 | 1.22 | 1.15 | 1.20 | 1.32 | 1.15 | 1.08 | 1.03 | 0.00 | 0 | HGG 3 |
| 5293028 | 1.13 | 0.54 to 1.36 | 0.54 | 1.28 | 1.04 | 1.15 | 1.21 | 1.16 | 1.02 | 1.35 | 1.36 | 0 | HGG 3 |
| 5322365 | 1.18 | 1.02 to 1.34 | 1.02 | 1.34 | 1.13 | 1.19 | 1.21 | 1.14 | 1.04 | 1.30 | 1.22 | 0 | HGG 3 |
| 5508135 | 1.40 | 1.03 to 1.73 | 1.23 | 1.73 | 1.56 | 1.67 | 1.57 | 1.49 | 1.06 | 1.26 | 1.03 | 0 | HGG 3 |
| 5512044 | 1.41 | 1.16 to 1.68 | 1.16 | 1.68 | 1.37 | 1.49 | 1.47 | 1.34 | 1.40 | 1.46 | 1.30 | 0 | HGG 3 |
| 554654 | 0.91 | 0.25 to 1.44 | 1.01 | 1.23 | 0.72 | 1.44 | 1.23 | 1.03 | 0.68 | 0.62 | 0.25 | 0 | HGG 3 |
| 621543 | 1.31 | 1.03 to 1.45 | 1.03 | 1.38 | 1.17 | 1.35 | 1.25 | 1.39 | 1.44 | 1.31 | 1.45 | 0 | HGG 3 |
| 664625 | 1.06 | 0.00 to 1.42 | 1.02 | 1.42 | 1.24 | 1.41 | 1.31 | 1.19 | 0.72 | 1.27 | 0.00 | 0 | HGG 3 |
| 872017 | 1.40 | 1.01 to 1.72 | 1.01 | 1.59 | 1.32 | 1.32 | 1.35 | 1.35 | 1.39 | 1.57 | 1.72 | 0 | HGG 3 |
| 5166479 | −1.50 | −1.92 to −0.89 | −1.45 | −1.80 | −1.69 | −1.12 | −1.69 | −1.92 | 0.89 | −1.38 | −1.56 | 1 | HGG 3 |
| 3778404 | −1.57 | −1.89 to −1.00 | −1.45 | −1.88 | −1.70 | −1.51 | −1.89 | −1.85 | −1.00 | −1.32 | −1.51 | 1 | HGG 3 |
| 3084204 | −1.32 | −1.56 to −0.92 | −1.19 | −1.48 | −1.28 | −1.40 | −1.48 | −1.56 | −0.92 | −1.16 | −1.42 | 1 | HGG 3 |
| 5399371 | −1.10 | −1.45 to −0.56 | −0.87 | −1.31 | −1.45 | −0.56 | −1.33 | −1.42 | −1.00 | −0.65 | −1.28 | 1 | HGG 3 |
| 5427710 | −1.76 | −2.12 to −1.37 | −1.37 | −1.99 | −1.70 | −1.76 | −1.83 | −2.12 | −1.42 | −1.77 | −1.91 | 1 | HGG 3 |
| 3120209 | −1.43 | −1.88 to −0.83 | −1.88 | −1.50 | −0.83 | −1.88 | −1.36 | −1.02 | −1.31 | −1.59 | −1.48 | 1 | HGG 3 |
| 3135460 | −1.02 | −1.82 to −0.57 | −0.68 | −1.04 | −1.23 | −0.80 | −1.27 | −1.82 | −0.57 | −0.71 | −1.10 | 1 | HGG 3 |
| 3125211 | −1.10 | −1.37 to −0.89 | −0.89 | −1.15 | −1.07 | −1.12 | −1.19 | −1.37 | −1.03 | −0.92 | −1.18 | 1 | HGG 3 |
| 5573589 | −1.29 | −1.59 to −0.99 | −1.03 | −1.35 | −1.20 | −1.36 | −1.55 | −1.59 | −0.99 | −1.21 | −1.30 | 1 | HGG 3 |
| 4289557 | −1.65 | −2.06 to −1.34 | −1.37 | −1.82 | −1.53 | −1.59 | −1.78 | −1.69 | −1.34 | −1.68 | −2.06 | 1 | HGG 3 |
| 1911443 | −0.84 | −1.37 to −0.40 | −0.78 | −0.79 | −1.25 | −0.53 | −0.87 | −1.37 | −0.40 | −0.71 | −0.90 | 1 | HGG 3 |
| 5089438 | −0.95 | −1.40 to −0.42 | −1.09 | −1.12 | −0.86 | −1.14 | −1.40 | −0.98 | −0.42 | −0.73 | −0.81 | 1 | HGG 3 |
| 5102731 | 1.72 | 1.48 to 1.97 | 1.48 | 1.86 | 1.73 | 1.73 | 1.65 | 1.75 | 1.97 | 1.53 | 1.82 | 2 | HGG 3 |
| 3068978 | 2.29 | 1.76 to 2.83 | 1.76 | 2.55 | 2.02 | 2.83 | 2.65 | 2.23 | 2.13 | 2.25 | 2.20 | 2 | HGG 3 |
| 5266015 | 2.01 | 1.72 to 2.21 | 1.72 | 2.15 | 1.92 | 2.05 | 2.02 | 1.92 | 2.03 | 2.11 | 2.21 | 2 | HGG 3 |
| 3074113 | 1.82 | 1.54 to 2.03 | 1.54 | 2.03 | 1.83 | 1.85 | 1.92 | 1.74 | 1.90 | 1.77 | 1.82 | 2 | HGG 3 |
| 3957354 | 2.12 | 1.73 to 2.51 | 2.08 | 2.51 | 2.11 | 2.21 | 2.09 | 2.24 | 1.73 | 2.10 | 1.96 | 2 | HGG 3 |
| 4253809 | 1.77 | 1.58 to 1.88 | 1.64 | 1.88 | 1.58 | 1.84 | 1.83 | 1.68 | 1.83 | 1.82 | 1.81 | 2 | HGG 3 |
| 4402555 | 1.79 | 1.47 to 2.02 | 1.47 | 1.94 | 1.76 | 1.70 | 1.83 | 1.79 | 1.66 | 1.96 | 2.02 | 2 | HGG 3 |
| 3091342 | −0.12 | −1.54 to 0.29 | 0.00 | 0.00 | 0.00 | 0.29 | 0.00 | −1.54 | 0.22 | 0.00 | 0.00 | 3 | HGG 3 |
| 4822285 | 0.32 | 0.00 to 1.39 | 0.00 | 0.14 | 0.03 | 0.15 | 0.10 | 0.31 | 0.56 | 1.39 | 0.23 | 3 | HGG 3 |
| 2532033 | 0.25 | 0.00 to 1.60 | 0.00 | 0.00 | 0.00 | 0.65 | 0.00 | 0.00 | 0.00 | 0.00 | 1.60 | 3 | HGG 3 |
| 699113 | 0.86 | 0.00 to 1.75 | 0.00 | 0.00 | 0.00 | 1.12 | 1.07 | 1.63 | 1.37 | 0.83 | 1.75 | 3 | HGG 3 |
| 3980695 | 0.59 | 0.00 to 1.77 | 0.00 | 0.00 | 0.28 | 0.44 | 0.00 | 0.73 | 0.93 | 1.17 | 1.77 | 3 | HGG 3 |
| 3069190 | 3.54 | 3.08 to 3.82 | 3.08 | 3.61 | 3.38 | 3.67 | 3.61 | 3.54 | 3.62 | 3.55 | 3.82 | 4 | HGG 3 |
| 3172265 | 3.67 | 3.21 to 4.02 | 3.21 | 4.02 | 3.61 | 3.47 | 3.70 | 3.59 | 3.75 | 3.98 | 3.68 | 4 | HGG 3 |
| 439415 | 1.14 | 0.80 to 1.36 | 0.80 | 1.36 | 1.36 | 1.18 | 1.33 | 1.31 | 0.99 | 0.88 | 1.09 | 0 | HGG 4 |
| 1365045 | 1.61 | 1.43 to 1.98 | 1.51 | 1.98 | 1.54 | 1.64 | 1.59 | 1.58 | 1.43 | 1.56 | 1.66 | 0 | HGG 4 |
| 1370137 | 2.17 | 1.54 to 2.53 | 1.54 | 2.27 | 1.84 | 2.26 | 2.48 | 2.53 | 2.08 | 2.15 | 2.36 | 0 | HGG 4 |
| 2006043 | 1.22 | 1.09 to 1.65 | 1.12 | 1.65 | 1.09 | 1.27 | 1.30 | 1.20 | 1.14 | 1.13 | 1.09 | 0 | HGG 4 |
| 3191030 | 1.59 | 0.71 to 2.32 | 1.98 | 2.32 | 1.71 | 1.59 | 1.94 | 1.78 | 1.33 | 0.96 | 0.71 | 0 | HGG 4 |
| 2007730 | 1.20 | 0.95 to 1.80 | 1.38 | 1.80 | 1.17 | 1.03 | 0.95 | 1.02 | 1.01 | 1.23 | 1.22 | 0 | HGG 4 |
| 2013251 | 1.87 | 1.68 to 2.27 | 1.68 | 2.27 | 1.83 | 1.74 | 1.96 | 1.95 | 1.68 | 1.72 | 1.99 | 0 | HGG 4 |
| 2350594 | 1.11 | 0.63 to 1.34 | 0.63 | 1.34 | 1.31 | 1.11 | 1.00 | 1.12 | 1.06 | 1.15 | 1.24 | 0 | HGG 4 |
| 2278772 | 2.40 | 2.07 to 2.91 | 2.53 | 2.15 | 2.07 | 2.74 | 2.91 | 2.59 | 2.29 | 2.15 | 2.19 | 0 | HGG 4 |
| 1964758 | 2.06 | 1.90 to 2.40 | 2.05 | 2.40 | 2.24 | 2.00 | 1.97 | 1.98 | 1.90 | 1.93 | 2.08 | 0 | HGG 4 |
| 1965856 | 1.20 | 0.92 to 1.47 | 1.13 | 1.12 | 1.35 | 1.42 | 1.47 | 1.26 | 1.15 | 0.94 | 0.92 | 0 | HGG 4 |
| 509839 | 1.38 | 1.11 to 1.59 | 1.17 | 1.55 | 1.54 | 1.30 | 1.59 | 1.57 | 1.25 | 1.11 | 1.35 | 0 | HGG 4 |
| 3188967 | 0.04 | −1.40 to 0.49 | 0.00 | 0.00 | −1.40 | 0.33 | 0.45 | 0.46 | 0.49 | 0.00 | 0.00 | 1 | HGG 4 |
| 3188631 | −0.17 | −1.91 to 0.41 | 0.00 | 0.00 | 0.00 | −1.91 | 0.41 | 0.00 | 0.00 | 0.00 | 0.00 | 1 | HGG 4 |
| 2013955 | 0.22 | −0.02 to 1.72 | 1.72 | 0.00 | 0.00 | 0.17 | −0.01 | 0.00 | −0.02 | −0.02 | 0.11 | 1 | HGG 4 |
| 2847867 | −0.10 | −1.78 to 0.51 | 0.00 | 0.00 | 0.00 | 0.51 | 0.40 | 0.00 | −1.78 | 0.00 | 0.00 | 1 | HGG 4 |
| 2756910 | −0.21 | −1.90 to 0.00 | 0.00 | 0.00 | 0.00 | 0.00 | 0.00 | 0.00 | −1.90 | 0.00 | 0.00 | 1 | HGG 4 |
| 2159706 | 0.23 | 0.00 to 2.03 | 2.03 | 0.00 | 0.00 | 0.00 | 0.00 | 0.00 | 0.00 | 0.00 | 0.00 | 1 | HGG 4 |
| 3221109 | 0.29 | 0.00 to 1.76 | 1.76 | 0.00 | 0.00 | 0.17 | 0.24 | 0.12 | 0.25 | 0.00 | 0.08 | 1 | HGG 4 |
| 3255873 | 0.03 | −1.36 to 0.73 | 0.00 | 0.00 | 0.00 | 0.40 | 0.26 | 0.29 | −1.36 | 0.00 | 0.73 | 1 | HGG 4 |
| 3190654 | 0.07 | −0.42 to 1.69 | 1.69 | 0.00 | −0.04 | −0.07 | −0.20 | −0.15 | −0.42 | −0.10 | −0.11 | 1 | HGG 4 |
| 955538 | 0.28 | 0.00 to 1.66 | 1.66 | 0.00 | 0.00 | 0.21 | 0.23 | 0.03 | 0.31 | 0.00 | 0.11 | 1 | HGG 4 |
| 3220149 | 0.53 | 0.00 to 1.36 | 0.00 | 0.00 | 0.00 | 1.31 | 1.36 | 1.29 | 0.86 | 0.00 | 0.00 | 2 | HGG 4 |
| 3016137 | 0.95 | 0.37 to 1.79 | 0.96 | 0.63 | 0.37 | 1.79 | 1.75 | 1.61 | 0.64 | 0.45 | 0.37 | 2 | HGG 4 |
| 3253556 | −0.03 | −1.48 to 0.42 | −1.48 | 0.00 | 0.00 | 0.32 | 0.42 | 0.27 | 0.24 | 0.00 | 0.00 | 2 | HGG 4 |
| 2753065 | 0.78 | 0.00 to 1.46 | 0.00 | 0.00 | 0.66 | 0.99 | 1.16 | 1.46 | 0.97 | 0.83 | 0.98 | 2 | HGG 4 |

TABLE 7-continued

| Clone ID | Ave DE t/prog | Range | mean DE t/prog 1 μM, 1 hr | mean DE t/prog 1 μM, 3 hr | mean DE t/prog 1 μM, 6 hr | mean DE t/prog 10 μM, 1 hr | mean DE t/prog 10 μM, 3 hr | mean DE t/prog 10 μM, 6 hr | mean DE t/prog 100 μM, 1 hr | mean DE t/prog 100 μM, 3 hr | mean DE t/prog 100 μM, 6 hr | Cluster | GEM |
|---|---|---|---|---|---|---|---|---|---|---|---|---|---|
| 4002388 | 0.04 | −1.52 to 0.35 | −1.52 | 0.00 | 0.00 | 0.29 | 0.34 | 0.27 | 0.35 | 0.28 | 0.31 | 2 | HGG 4 |
| 4077648 | 0.95 | 0.34 to 1.38 | 0.77 | 0.88 | 0.34 | 1.38 | 1.02 | 1.12 | 1.08 | 0.83 | 1.10 | 2 | HGG 4 |
| 1323327 | 0.83 | 0.00 to 1.37 | 0.77 | 0.00 | 0.48 | 1.10 | 1.37 | 1.21 | 0.86 | 0.76 | 0.93 | 2 | HGG 4 |
| 2751922 | 0.91 | 0.19 to 1.37 | 0.19 | 1.37 | 1.17 | 0.92 | 1.03 | 1.00 | 0.80 | 0.81 | 0.89 | 2 | HGG 4 |
| 1448572 | 0.82 | 0.37 to 1.44 | 0.37 | 1.44 | 0.84 | 0.74 | 0.76 | 0.84 | 0.76 | 0.83 | 0.77 | 2 | HGG 4 |
| 3390535 | 0.30 | 0.00 to 1.33 | 0.57 | 1.33 | 0.81 | 0.00 | 0.00 | 0.00 | 0.00 | 0.00 | 0.00 | 3 | HGG 4 |
| 1679683 | 0.25 | −0.38 to 2.11 | 0.00 | 2.11 | 0.00 | 0.43 | −0.38 | 0.00 | 0.04 | 0.00 | 0.04 | 3 | HGG 4 |
| 21957 | 0.47 | 0.00 to 1.42 | 1.39 | 1.42 | 1.38 | 0.00 | 0.00 | 0.00 | 0.00 | 0.00 | 0.00 | 3 | HGG 4 |
| 2277161 | 0.42 | −0.20 to 1.69 | −0.20 | 1.69 | 0.27 | 0.49 | 0.31 | 0.27 | 0.44 | 0.27 | 0.23 | 3 | HGG 4 |
| 4631069 | 0.37 | 0.00 to 2.30 | 0.00 | 2.30 | 0.00 | 0.13 | 0.05 | 0.46 | 0.15 | 0.00 | 0.20 | 3 | HGG 4 |
| 2325802 | 0.76 | 0.00 to 2.62 | 2.07 | 2.62 | 2.14 | 0.00 | 0.00 | 0.00 | 0.00 | 0.00 | 0.00 | 3 | HGG 4 |
| 2427327 | 0.68 | 0.00 to 2.37 | 1.76 | 2.37 | 1.97 | 0.00 | 0.00 | 0.00 | 0.00 | 0.00 | 0.00 | 3 | HGG 4 |
| 2408333 | 1.16 | 0.70 to 1.71 | 0.71 | 0.70 | 0.78 | 1.51 | 1.71 | 1.54 | 1.35 | 1.01 | 1.12 | 4 | HGG 4 |
| 2581075 | 2.55 | 0.56 to 3.53 | 0.97 | 0.90 | 0.56 | 3.52 | 3.53 | 3.36 | 3.37 | 3.43 | 3.27 | 4 | HGG 4 |
| 2267466 | 1.06 | 0.00 to 1.45 | 0.67 | 0.00 | 0.76 | 1.31 | 1.34 | 1.28 | 1.45 | 1.26 | 1.43 | 4 | HGG 4 |
| 2266959 | 0.96 | 0.00 to 1.35 | 0.68 | 0.00 | 0.83 | 1.27 | 1.19 | 1.08 | 1.35 | 1.07 | 1.15 | 4 | HGG 4 |
| 2106010 | 1.21 | 0.00 to 1.52 | 0.93 | 0.00 | 1.25 | 1.51 | 1.51 | 1.52 | 1.28 | 1.38 | 1.50 | 4 | HGG 4 |
| 434751 | 1.10 | 0.00 to 1.81 | 0.00 | 0.00 | 0.00 | 1.81 | 1.63 | 1.49 | 1.58 | 1.71 | 1.70 | 4 | HGG 4 |
| 1600180 | 1.06 | 0.00 to 1.50 | 0.99 | 0.00 | 0.74 | 1.16 | 1.27 | 1.50 | 1.28 | 1.26 | 1.34 | 4 | HGG 4 |
| 1857850 | −1.86 | −2.28 to −1.44 | −1.69 | −1.93 | −1.44 | −1.86 | −2.28 | −2.21 | −1.85 | −1.69 | −1.79 | 5 | HGG 4 |
| 2786442 | −1.34 | −1.56 to −1.05 | −1.13 | −1.56 | −1.25 | −1.51 | −1.44 | −1.49 | −1.31 | −1.05 | −1.33 | 5 | HGG 4 |
| 3042227 | −1.26 | −1.72 to −0.93 | −1.00 | −1.48 | −1.24 | −1.31 | −1.47 | −1.72 | −1.09 | −0.93 | −1.11 | 5 | HGG 4 |
| 2055569 | −0.88 | −1.84 to −0.11 | −0.62 | −1.24 | −1.42 | −0.36 | −1.12 | −1.84 | −0.11 | −0.43 | −0.79 | 5 | HGG 4 |
| 1449819 | −1.36 | −2.39 to −0.56 | −0.56 | −1.81 | −2.28 | −0.66 | −1.59 | −2.39 | −0.62 | −0.89 | −1.48 | 5 | HGG 4 |
| 1383138 | −0.88 | −1.36 to −0.44 | −0.77 | −1.25 | −1.03 | −0.53 | −1.13 | −1.36 | −0.44 | −0.57 | −0.81 | 5 | HGG 4 |

TABLE 8

| Clone ID | Ave DE t/Beclo | Range | mean DE t/Beclo 1 μM, 1 hr | mean DE t/Beclo 1 μM, 3 hr | mean DE t/Beclo 1 μM, 6 hr | mean DE t/Beclo 10 μM, 1 hr | mean DE t/Beclo 10 μM, 3 hr | mean DE t/Beclo 10 μM, 6 hr | mean DE t/Beclo 100 μM, 1 hr | mean DE t/Beclo 100 μM, 3 hr | mean DE t/Beclo 100 μM, 1 hr | Cluster | GEM |
|---|---|---|---|---|---|---|---|---|---|---|---|---|---|
| 1004382 | 1.10 | 0.91 to 1.45 | 1.11 | 0.91 | 0.91 | 1.11 | 1.45 | 0.96 | 1.31 | 1.13 | 1.01 | 0 | HGG1 |
| 2313349 | 1.45 | 1 to 1.86 | 1.40 | 1.33 | 1.23 | 1.51 | 1.86 | 1.57 | 1.61 | 1.41 | 1.17 | 0 | HGG1 |
| 1236305 | 0.89 | 0.69 to 1.32 | 0.99 | 0.76 | 0.74 | 1.06 | 1.32 | 0.89 | 0.78 | 0.69 | 0.77 | 0 | HGG1 |
| 1241484 | 1.37 | 1.14 to 1.75 | 1.44 | 1.29 | 1.24 | 1.14 | 1.75 | 1.37 | 1.60 | 1.31 | 1.22 | 0 | HGG1 |
| 1268277 | 1.13 | 0.78 to 1.41 | 1.14 | 0.97 | 0.94 | 1.10 | 1.41 | 1.33 | 1.41 | 1.10 | 0.78 | 0 | HGG1 |
| 1275616 | 0.94 | 0.54 to 1.35 | 0.97 | 0.85 | 0.73 | 1.17 | 1.35 | 0.99 | 0.95 | 0.94 | 0.54 | 0 | HGG1 |
| 1320685 | 1.65 | 1.39 to 2.10 | 1.59 | 1.46 | 1.39 | 1.72 | 2.10 | 1.67 | 1.87 | 1.57 | 1.44 | 0 | HGG1 |
| 1342744 | 1.60 | 1.15 to 2.03 | 1.38 | 1.31 | 1.15 | 1.83 | 2.03 | 1.72 | 1.96 | 1.57 | 1.44 | 0 | HGG1 |
| 136073 | 0.99 | 0.00 to 1.70 | 1.03 | 0.96 | 0.72 | 0.00 | 1.70 | 1.07 | 1.18 | 1.04 | 1.17 | 0 | HGG1 |
| 139949 | 1.14 | 0.00 to 1.82 | 1.12 | 1.09 | 0.73 | 1.26 | 1.54 | 1.03 | 1.82 | 1.65 | 0.00 | 0 | HGG1 |
| 143765 | 1.24 | 0.94 to 1.67 | 0.99 | 1.08 | 0.94 | 1.28 | 1.18 | 1.39 | 1.67 | 1.44 | 1.13 | 0 | HGG1 |
| 3595618 | 1.41 | 1.09 to 1.75 | 1.37 | 1.29 | 1.09 | 1.56 | 1.69 | 1.35 | 1.75 | 1.44 | 1.16 | 0 | HGG1 |
| 2830240 | 0.98 | 0.83 to 1.35 | 0.99 | 0.96 | 0.94 | 0.84 | 1.35 | 1.02 | 0.94 | 0.83 | 0.95 | 0 | HGG1 |
| 1459743 | 1.52 | 1.13 to 2.12 | 1.35 | 1.21 | 1.13 | 1.67 | 2.12 | 1.82 | 1.61 | 1.56 | 1.20 | 0 | HGG1 |
| 1521272 | 1.19 | 0.83 to 1.93 | 1.01 | 0.89 | 0.83 | 1.64 | 1.93 | 1.15 | 1.27 | 1.09 | 0.92 | 0 | HGG1 |
| 1560906 | 1.27 | 0.00 to 1.75 | 1.32 | 1.29 | 1.03 | 1.47 | 1.75 | 1.41 | 1.64 | 1.48 | 0.00 | 0 | HGG1 |
| 1573840 | 0.97 | 0.55 to 1.41 | 1.01 | 0.82 | 0.55 | 0.95 | 1.41 | 0.95 | 1.21 | 0.90 | 0.90 | 0 | HGG1 |
| 3497231 | 1.19 | 1.06 to 1.37 | 1.37 | 1.18 | 1.09 | 1.06 | 1.28 | 1.27 | 1.19 | 1.13 | 1.09 | 0 | HGG1 |
| 2445967 | 1.38 | 1.06 to 1.67 | 1.34 | 1.24 | 1.06 | 1.46 | 1.67 | 1.29 | 1.67 | 1.40 | 1.30 | 0 | HGG1 |
| 1609387 | 1.15 | 0.84 to 1.58 | 1.06 | 0.95 | 0.84 | 0.91 | 1.58 | 1.26 | 1.53 | 1.26 | 0.93 | 0 | HGG1 |
| 1610828 | 1.17 | 0.97 to 1.47 | 1.13 | 1.04 | 1.02 | 1.42 | 1.47 | 1.13 | 1.24 | 1.14 | 0.97 | 0 | HGG1 |
| 3123530 | 0.77 | 0.37 to 1.33 | 0.61 | 0.52 | 0.58 | 0.75 | 1.33 | 0.79 | 1.03 | 0.96 | 0.37 | 0 | HGG1 |
| 2459765 | 1.22 | 0.86 to 1.67 | 1.18 | 0.98 | 0.86 | 1.42 | 1.67 | 1.23 | 1.52 | 1.11 | 0.98 | 0 | HGG1 |
| 2778441 | 1.39 | 1.04 to 1.84 | 1.31 | 1.15 | 1.04 | 1.57 | 1.84 | 1.45 | 1.55 | 1.46 | 1.14 | 0 | HGG1 |
| 671717 | 1.22 | 0.00 to 2.11 | 1.50 | 1.23 | 1.35 | 0.00 | 2.11 | 1.49 | 1.78 | 1.48 | 0.00 | 0 | HGG1 |
| 5398701 | 0.82 | 0.23 to 1.32 | 0.94 | 1.32 | 1.06 | 0.98 | 0.23 | 0.92 | 0.46 | 0.81 | 0.70 | 0 | HGG1 |
| 531505 | 1.15 | 0.85 to 1.51 | 1.12 | 1.02 | 1.02 | 1.31 | 1.24 | 1.51 | 1.28 | 0.99 | 0.85 | 0 | HGG1 |
| 5275693 | 1.00 | 0.61 to 1.60 | 0.97 | 0.85 | 0.79 | 1.19 | 1.60 | 1.12 | 1.06 | 0.81 | 0.61 | 0 | HGG1 |
| 5098879 | 1.12 | 0.55 to 1.79 | 0.80 | 0.55 | 0.60 | 1.26 | 1.71 | 1.09 | 1.79 | 1.34 | 0.92 | 0 | HGG1 |
| 5046235 | 1.18 | 0.63 to 1.89 | 0.90 | 0.86 | 0.63 | 1.56 | 1.89 | 1.19 | 1.42 | 1.18 | 1.02 | 0 | HGG1 |
| 4978708 | 1.34 | 1.08 to 1.56 | 1.56 | 1.31 | 1.19 | 1.38 | 1.46 | 1.45 | 1.39 | 1.28 | 1.08 | 0 | HGG1 |
| 435610 | 0.80 | 0.00 to 3.25 | 0.38 | 0.47 | 0.25 | 0.00 | 0.30 | 0.18 | 3.25 | 1.75 | 0.60 | 0 | HGG1 |
| 2494284 | 1.12 | 0.82 to 1.58 | 0.98 | 0.87 | 0.86 | 1.30 | 1.58 | 1.01 | 1.39 | 1.31 | 0.82 | 0 | HGG1 |
| 2506425 | 0.88 | 0.53 to 1.33 | 0.87 | 1.12 | 0.59 | 1.06 | 1.33 | 0.74 | 0.75 | 0.53 | 0.93 | 0 | HGG1 |
| 4286760 | 1.13 | 0.65 to 1.50 | 0.88 | 1.21 | 1.14 | 0.84 | 0.65 | 1.08 | 1.42 | 1.50 | 1.49 | 0 | HGG1 |
| 4087621 | 0.89 | 0.42 to 1.33 | 1.01 | 1.33 | 1.06 | 1.25 | 0.42 | 1.13 | 0.46 | 0.80 | 0.54 | 0 | HGG1 |

TABLE 8-continued

| Clone ID | Ave DE t/Beclo | Range | mean DE t/Beclo 1 μM, 1 hr | mean DE t/Beclo 1 μM, 3 hr | mean DE t/Beclo 1 μM, 6 hr | mean DE t/Beclo 10 μM, 1 hr | mean DE t/Beclo 10 μM, 3 hr | mean DE t/Beclo 10 μM, 6 hr | mean DE t/Beclo 100 μM, 1 hr | mean DE t/Beclo 100 μM, 3 hr | mean DE t/Beclo 100 μM, 1 hr | Cluster | GEM |
|---|---|---|---|---|---|---|---|---|---|---|---|---|---|
| 4021009 | 1.15 | 0.89 to 1.57 | 1.09 | 0.91 | 0.89 | 1.29 | 1.57 | 1.14 | 1.34 | 1.13 | 0.99 | 0 | HGG1 |
| 4018288 | 0.88 | 0.57 to 1.41 | 0.81 | 0.61 | 0.57 | 0.70 | 1.41 | 0.81 | 1.37 | 0.98 | 0.70 | 0 | HGG1 |
| 3108506 | 1.06 | 0.52 to 1.43 | 0.91 | 0.79 | 0.86 | 1.07 | 1.34 | 1.40 | 1.43 | 1.20 | 0.52 | 0 | HGG1 |
| 1944123 | 1.17 | 0.83 to 1.47 | 1.01 | 0.93 | 0.83 | 1.34 | 1.47 | 1.43 | 1.39 | 1.17 | 0.97 | 0 | HGG1 |
| 1956982 | 1.30 | 0.93 to 1.56 | 1.40 | 1.43 | 0.93 | 1.04 | 1.35 | 1.20 | 1.44 | 1.35 | 1.56 | 0 | HGG1 |
| 400654 | 1.06 | 0.81 to 1.36 | 1.18 | 1.18 | 1.02 | 1.21 | 1.36 | 1.00 | 0.90 | 0.81 | 0.85 | 0 | HGG1 |
| 3821432 | 1.40 | 0.81 to 1.94 | 1.20 | 1.11 | 0.81 | 1.71 | 1.94 | 1.36 | 1.86 | 1.40 | 1.19 | 0 | HGG1 |
| 371201 | 1.26 | 0.94 to 1.64 | 1.01 | 1.04 | 0.94 | 1.40 | 1.64 | 1.31 | 1.60 | 1.34 | 1.04 | 0 | HGG1 |
| 3075994 | 1.04 | 0.86 to 1.38 | 1.03 | 0.89 | 0.87 | 0.96 | 1.38 | 1.00 | 1.32 | 1.10 | 0.86 | 0 | HGG1 |
| 2516950 | 1.67 | 1.41 to 2.16 | 1.71 | 1.56 | 1.42 | 1.81 | 2.16 | 1.70 | 1.79 | 1.49 | 1.41 | 0 | HGG1 |
| 3687719 | 1.46 | 1.00 to 1.92 | 1.25 | 1.17 | 1.00 | 1.60 | 1.71 | 1.39 | 1.92 | 1.59 | 1.50 | 0 | HGG1 |
| 3687607 | 1.03 | 0.77 to 1.51 | 0.99 | 0.89 | 0.77 | 1.11 | 1.51 | 1.08 | 1.18 | 0.96 | 0.82 | 0 | HGG1 |
| 3606947 | 0.99 | 0.61 to 1.52 | 0.86 | 0.79 | 0.61 | 1.28 | 1.52 | 1.03 | 1.18 | 0.82 | 0.79 | 0 | HGG1 |
| 2120743 | 1.55 | 1.34 to 2.03 | 1.63 | 1.41 | 1.34 | 1.45 | 2.03 | 1.49 | 1.65 | 1.52 | 1.42 | 0 | HGG1 |
| 2833342 | 1.43 | 1.06 to 1.89 | 1.38 | 1.24 | 1.15 | 1.66 | 1.89 | 1.48 | 1.70 | 1.34 | 1.06 | 0 | HGG1 |
| 2756333 | 1.46 | 0.92 to 2.07 | 1.19 | 0.97 | 1.10 | 1.87 | 2.07 | 1.68 | 1.75 | 1.55 | 0.92 | 0 | HGG1 |
| 2148703 | 0.98 | 0.74 to 1.32 | 0.95 | 0.95 | 0.95 | 1.00 | 1.32 | 1.02 | 0.91 | 0.74 | 0.95 | 0 | HGG1 |
| 2636759 | 0.81 | 0.30 to 1.45 | 0.54 | 0.30 | 0.43 | 0.76 | 1.43 | 0.80 | 1.45 | 1.01 | 0.58 | 0 | HGG1 |
| 2311213 | 1.01 | 0.58 to 1.54 | 0.66 | 0.69 | 0.58 | 1.54 | 1.42 | 0.88 | 1.47 | 1.06 | 0.83 | 0 | HGG1 |
| 3681722 | −1.17 | −1.35 to −1.02 | −1.02 | −1.10 | −1.09 | −1.05 | −1.18 | −1.26 | −1.27 | −1.19 | −1.35 | 1 | HGG1 |
| 3973887 | −0.91 | −1.37 to −0.50 | −0.50 | −0.73 | −0.65 | −1.07 | −0.95 | −0.82 | −1.37 | −1.17 | −0.93 | 1 | HGG1 |
| 41479 | −1.08 | −1.59 to −0.82 | −1.17 | −0.82 | −1.00 | −1.05 | −1.59 | −1.02 | −0.89 | −0.99 | −1.19 | 1 | HGG1 |
| 4246966 | −1.04 | −1.32 to −0.64 | −0.64 | −0.84 | −0.75 | −1.32 | −1.21 | −0.98 | −1.16 | −1.32 | −1.12 | 1 | HGG1 |
| 4297813 | −1.09 | −1.39 to −0.87 | −0.87 | −0.88 | −0.87 | −1.39 | −1.31 | −1.02 | −1.14 | −1.20 | −1.11 | 1 | HGG1 |
| 1614014 | −0.92 | −1.40 to −0.62 | −0.92 | −0.77 | −0.68 | −1.32 | −1.40 | −0.86 | −0.93 | −0.74 | −0.62 | 1 | HGG1 |
| 4698018 | −1.21 | −1.66 to −0.97 | −1.07 | −1.04 | −1.03 | −1.47 | −1.66 | −1.47 | −1.05 | −0.97 | −1.13 | 1 | HGG1 |
| 963331 | −1.01 | −1.35 to −0.82 | −0.82 | −0.87 | −0.87 | −1.22 | −1.35 | −1.06 | −1.12 | −0.90 | −0.90 | 1 | HGG1 |
| 1833362 | −1.03 | −1.76 to −0.67 | −1.12 | −0.97 | −0.99 | −1.06 | −1.76 | −1.12 | −0.72 | −0.67 | −0.90 | 1 | HGG1 |
| 1840426 | −1.13 | −1.50 to −0.95 | −0.95 | −1.02 | −1.10 | −0.95 | −1.36 | −1.15 | −1.08 | −1.04 | −1.50 | 1 | HGG1 |
| 1910401 | −1.19 | −1.64 to −0.97 | −0.98 | −0.98 | −1.04 | −1.47 | −1.64 | −0.97 | −1.03 | −1.06 | −1.06 | 1 | HGG1 |
| 2047730 | −1.24 | −1.86 to −0.65 | −1.28 | −1.06 | −1.28 | −1.36 | −1.86 | −1.50 | −0.83 | −0.65 | −1.31 | 1 | HGG1 |
| 2055814 | −1.03 | −1.33 to −0.69 | −0.99 | −0.89 | −1.16 | −0.99 | −1.33 | −1.27 | −0.69 | −0.84 | −1.13 | 1 | HGG1 |
| 2132606 | −1.07 | −1.33 to −0.79 | −0.80 | −0.79 | −1.18 | −0.80 | −1.16 | −1.06 | −1.21 | −1.30 | −1.33 | 1 | HGG1 |
| 2132607 | −1.15 | −1.77 to −0.83 | −1.04 | −0.94 | −1.01 | −1.35 | −1.40 | −0.96 | −0.83 | −1.00 | −1.77 | 1 | HGG1 |
| 2287724 | −1.05 | −1.34 to −0.69 | −0.71 | −0.69 | −0.93 | −1.05 | −1.13 | −1.04 | −1.34 | −1.33 | −1.22 | 1 | HGG1 |
| 2372040 | −1.05 | −1.52 to −0.74 | −0.95 | −0.85 | −0.97 | −1.23 | −1.52 | −1.14 | −0.74 | −0.76 | −1.28 | 1 | HGG1 |
| 2471835 | −1.21 | −1.57 to −0.76 | −0.85 | −0.76 | −1.00 | −1.26 | −1.24 | −1.11 | −1.57 | −1.53 | −1.53 | 1 | HGG1 |
| 2623304 | −1.13 | −1.54 to −0.65 | −1.22 | −1.20 | −1.27 | −0.94 | −1.54 | −1.54 | −0.65 | −0.80 | −1.13 | 1 | HGG1 |
| 2769888 | −1.15 | −1.71 to −0.50 | −0.50 | −0.99 | −1.45 | −0.96 | −1.13 | −1.71 | −0.63 | −1.35 | −1.60 | 1 | HGG1 |
| 2947188 | −1.02 | −1.48 to −0.77 | −1.01 | −0.81 | −0.77 | −1.35 | −1.48 | −1.06 | −1.03 | −0.82 | −0.86 | 1 | HGG1 |
| 3126622 | −1.11 | −1.73 to −0.87 | −1.26 | −0.87 | −0.89 | −1.13 | −1.73 | −1.08 | −1.01 | −0.95 | −1.05 | 1 | HGG1 |
| 3397390 | −1.14 | −1.40 to −0.87 | −0.87 | −1.07 | −0.99 | −1.40 | −1.40 | −1.26 | −0.97 | −1.03 | −1.31 | 1 | HGG1 |
| 1210839 | 1.05 | 0.00 to 1.75 | 1.34 | 1.16 | 1.13 | 1.08 | 1.75 | 1.32 | 0.00 | 1.63 | 0.00 | 2 | HGG1 |
| 2061171 | 0.81 | 0.00 to 1.69 | 1.04 | 0.87 | 0.86 | 0.00 | 1.69 | 1.44 | 0.00 | 1.37 | 0.00 | 2 | HGG1 |
| 2697275 | 1.21 | 0.00 to 1.80 | 1.34 | 1.10 | 1.20 | 1.80 | 1.63 | 1.44 | 0.00 | 1.26 | 1.15 | 2 | HGG1 |
| 3391835 | 0.92 | 0.00 to 2.36 | 1.51 | 1.64 | 1.14 | 0.00 | 2.36 | 1.61 | 0.00 | 0.00 | 0.00 | 2 | HGG1 |
| 279898 | 1.06 | 0.08 to 1.67 | 0.40 | 1.15 | 1.46 | 0.08 | 1.46 | 1.59 | 0.10 | 1.63 | 1.67 | 2 | HGG1 |
| 1995520 | 0.82 | 0.00 to 1.44 | 1.22 | 0.93 | 0.79 | 0.00 | 1.44 | 0.94 | 0.00 | 1.13 | 0.92 | 2 | HGG1 |
| 4092112 | 0.97 | 0.00 to 1.84 | 0.99 | 1.03 | 0.83 | 0.00 | 1.84 | 1.22 | 0.00 | 1.75 | 1.05 | 2 | HGG1 |
| 2046717 | 0.98 | 0.00 to 1.38 | 1.13 | 1.06 | 0.82 | 1.17 | 1.38 | 1.01 | 0.00 | 1.19 | 1.08 | 2 | HGG1 |
| 2403438 | 1.48 | 0.00 to 2.26 | 1.88 | 1.78 | 1.76 | 2.15 | 2.17 | 2.26 | 0.00 | 1.36 | 0.00 | 2 | HGG1 |
| 4554722 | 1.00 | 0.00 to 1.81 | 0.83 | 0.71 | 0.66 | 1.54 | 1.81 | 1.47 | 0.00 | 1.35 | 0.65 | 2 | HGG1 |
| 1756875 | 1.02 | 0.00 to 2.25 | 1.32 | 1.22 | 1.14 | 1.65 | 2.25 | 1.63 | 0.00 | 0.00 | 0.00 | 2 | HGG1 |
| 5501676 | 1.49 | 0.00 to 3.22 | 2.72 | 2.69 | 2.07 | 0.00 | 3.22 | 2.72 | 0.00 | 0.00 | 0.00 | 2 | HGG1 |
| 5509134 | 1.80 | 0.00 to 2.56 | 2.30 | 2.19 | 2.07 | 2.56 | 2.38 | 1.95 | 0.00 | 1.43 | 1.30 | 2 | HGG1 |
| 3057272 | 0.83 | 0.00 to 1.65 | 0.79 | 0.85 | 0.52 | 1.65 | 1.47 | 1.15 | 0.00 | 1.08 | 0.00 | 2 | HGG1 |
| 305751 | 1.25 | 0.00 to 2.51 | 1.22 | 1.24 | 1.20 | 2.51 | 1.97 | 1.43 | 0.00 | 1.66 | 0.00 | 2 | HGG1 |
| 3068809 | 1.64 | 0.00 to 2.43 | 2.15 | 1.93 | 1.91 | 2.23 | 2.43 | 2.18 | 0.00 | 1.97 | 0.00 | 2 | HGG1 |
| 2511277 | 1.49 | 0.00 to 2.22 | 1.53 | 1.51 | 1.37 | 1.95 | 2.22 | 2.05 | 0.00 | 1.73 | 1.04 | 2 | HGG1 |
| 1457424 | 2.31 | 1.89 to 2.84 | 2.07 | 2.16 | 1.96 | 2.69 | 2.84 | 2.44 | 2.51 | 2.24 | 1.89 | 3 | HGG1 |
| 3606046 | 1.86 | 1.28 to 2.44 | 1.69 | 1.43 | 1.28 | 1.89 | 2.44 | 2.06 | 2.43 | 1.98 | 1.49 | 3 | HGG1 |
| 4287327 | 2.43 | 2.16 to 2.96 | 2.16 | 2.30 | 2.18 | 2.19 | 2.68 | 2.30 | 2.51 | 2.96 | 2.62 | 3 | HGG1 |
| 1630990 | 3.17 | 2.79 to 3.39 | 3.32 | 3.21 | 2.98 | 3.38 | 3.39 | 3.34 | 3.24 | 2.79 | 2.84 | 3 | HGG1 |
| 3792988 | 2.26 | 1.68 to 2.92 | 1.97 | 1.78 | 1.68 | 2.20 | 2.91 | 2.43 | 2.92 | 2.51 | 1.97 | 3 | HGG1 |
| 2755836 | 3.71 | 2.86 to 4.47 | 3.56 | 3.34 | 3.27 | 4.47 | 4.42 | 4.32 | 3.77 | 2.86 | 3.37 | 3 | HGG1 |
| 2956444 | 1.95 | 1.64 to 2.43 | 1.92 | 1.77 | 1.64 | 1.98 | 2.43 | 2.24 | 2.02 | 1.85 | 1.70 | 3 | HGG1 |
| 2110430 | 1.85 | 1.37 to 2.40 | 1.65 | 1.63 | 1.37 | 2.22 | 2.40 | 1.75 | 2.09 | 1.89 | 1.63 | 3 | HGG1 |
| 2823767 | 1.75 | 1.34 to 2.35 | 1.71 | 1.69 | 1.34 | 1.73 | 2.35 | 1.71 | 1.96 | 1.75 | 1.49 | 3 | HGG1 |
| 459372 | 1.96 | 1.68 to 2.27 | 2.01 | 1.93 | 1.78 | 2.14 | 2.27 | 1.97 | 1.99 | 1.85 | 1.68 | 3 | HGG1 |
| 2818476 | 2.12 | 0.00 to 4.04 | 2.86 | 2.85 | 2.41 | 3.79 | 4.04 | 3.12 | 0.00 | 0.00 | 0.00 | 3 | HGG1 |
| 1684617 | 1.75 | 1.35 to 2.48 | 1.58 | 1.35 | 1.43 | 1.66 | 2.48 | 1.89 | 2.18 | 1.79 | 1.40 | 3 | HGG1 |
| 548114 | 1.71 | 0.00 to 2.25 | 1.89 | 1.86 | 1.73 | 2.13 | 2.25 | 1.99 | 1.75 | 1.80 | 0.00 | 3 | HGG1 |
| 4549259 | 3.18 | 2.53 to 3.89 | 2.93 | 2.76 | 2.53 | 3.61 | 3.89 | 3.28 | 3.49 | 3.09 | 2.98 | 3 | HGG1 |

TABLE 8-continued

| Clone ID | Ave DE t/Beclo | Range | mean DE t/Beclo 1 μM, 1 hr | mean DE t/Beclo 1 μM, 3 hr | mean DE t/Beclo 1 μM, 6 hr | mean DE t/Beclo 10 μM, 1 hr | mean DE t/Beclo 10 μM, 3 hr | mean DE t/Beclo 10 μM, 6 hr | mean DE t/Beclo 100 μM, 1 hr | mean DE t/Beclo 100 μM, 3 hr | mean DE t/Beclo 100 μM, 1 hr | Cluster | GEM |
|---|---|---|---|---|---|---|---|---|---|---|---|---|---|
| 2520894 | 2.32 | 1.58 to 3.13 | 1.96 | 1.83 | 1.58 | 2.50 | 3.13 | 2.52 | 2.79 | 2.48 | 2.05 | 3 | HGG1 |
| 617587 | 1.74 | 0.00 to 2.79 | 1.62 | 1.48 | 1.25 | 2.59 | 2.79 | 1.91 | 2.00 | 1.99 | 0.00 | 3 | HGG1 |
| 1596220 | −1.64 | −2.24 to −1.18 | −1.75 | −1.49 | −1.76 | −1.70 | −2.24 | −1.82 | −1.25 | −1.18 | −1.53 | 4 | HGG1 |
| 3001212 | −1.51 | −2.33 to −1.21 | −1.61 | −1.25 | −1.36 | −1.84 | −2.33 | −1.47 | −1.23 | −1.21 | −1.33 | 4 | HGG1 |
| 2506973 | −1.56 | −2.07 to −1.11 | −1.56 | −1.42 | −1.66 | −1.77 | −2.07 | −1.71 | −1.27 | −1.11 | −1.49 | 4 | HGG1 |
| 1740474 | −1.48 | −1.83 to −1.22 | −1.39 | −1.33 | −1.55 | −1.79 | −1.83 | −1.66 | −1.31 | −1.28 | −1.22 | 4 | HGG1 |
| 5291518 | −1.49 | −1.81 to −1.18 | −1.27 | −1.39 | −1.18 | −1.73 | −1.81 | −1.46 | −1.48 | −1.49 | −1.60 | 4 | HGG1 |
| 3679667 | −1.34 | −1.73 to −1.05 | −1.05 | −1.15 | −1.12 | −1.48 | −1.73 | −1.37 | −1.31 | −1.40 | −1.46 | 4 | HGG1 |
| 2061528 | −1.42 | −1.69 to −1.23 | −1.33 | −1.34 | −1.23 | −1.47 | −1.61 | −1.43 | −1.39 | −1.30 | −1.69 | 4 | HGG1 |
| 1868536 | −1.36 | −1.85 to −0.84 | −1.27 | −1.19 | −1.45 | −1.52 | −1.83 | −1.85 | −0.84 | −1.08 | −1.24 | 4 | HGG1 |
| 4408943 | −1.55 | −2.08 to −0.99 | −1.52 | −1.32 | −1.54 | −1.74 | −2.08 | −1.88 | −0.99 | −1.22 | −1.64 | 4 | HGG1 |
| 1441245 | −1.50 | −2.16 to −0.98 | −1.17 | −1.13 | −0.98 | −1.96 | −2.16 | −1.69 | −1.57 | −1.43 | −1.43 | 4 | HGG1 |
| 891072 | −1.43 | −1.83 to −1.13 | −1.36 | −1.28 | −1.54 | −1.38 | −1.83 | −1.70 | −1.21 | −1.13 | −1.47 | 4 | HGG1 |
| 3451645 | −0.99 | −1.49 to −0.32 | −0.82 | −0.96 | −1.32 | −0.90 | −1.49 | −1.38 | −0.32 | −0.70 | −1.07 | 5 | HGG1 |
| 1807155 | −0.93 | −1.52 to −0.29 | −0.63 | −0.78 | −1.06 | −0.94 | −1.52 | −1.47 | −0.29 | −0.63 | −1.03 | 5 | HGG1 |
| 2839946 | −0.94 | −1.36 to −0.49 | −0.86 | −1.05 | −1.11 | −1.01 | −1.36 | −1.18 | −0.51 | −0.49 | −0.90 | 5 | HGG1 |
| 2447829 | −0.67 | −1.43 to 0.00 | −0.59 | −0.54 | −0.75 | −0.79 | −0.89 | −0.87 | 0.00 | −0.19 | −1.43 | 5 | HGG1 |
| 4253663 | −0.70 | −1.45 to −0.36 | −0.63 | −0.64 | −0.91 | −1.45 | −0.84 | −0.36 | −0.41 | −0.43 | 5 | HGG1 |
| 3686603 | −0.85 | −1.45 to −0.44 | −0.87 | −0.85 | −0.88 | −0.84 | −1.45 | −0.94 | −0.63 | −0.44 | −0.78 | 5 | HGG1 |
| 1697719 | −0.69 | −1.63 to 0.00 | −0.77 | −0.62 | −0.67 | −0.90 | −1.63 | −0.88 | 0.00 | 0.00 | −0.72 | 5 | HGG1 |
| 4284270 | −0.70 | −1.40 to −0.38 | −0.55 | −0.38 | −0.61 | −0.73 | −1.40 | −0.97 | −0.46 | −0.62 | −0.59 | 5 | HGG1 |
| 1602328 | −0.82 | −1.49 to −0.33 | −0.43 | −0.70 | −0.94 | −0.88 | −1.49 | −0.98 | −0.33 | −0.60 | −0.99 | 5 | HGG1 |
| 2695371 | 0.51 | 0.00 to 1.39 | 0.87 | 0.71 | 0.71 | 0.00 | 1.39 | 0.92 | 0.00 | 0.00 | 0.00 | 6 | HGG1 |
| 1723834 | 0.47 | 0.00 to 1.56 | 0.87 | 0.00 | 0.85 | 0.00 | 1.56 | 0.96 | 0.00 | 0.00 | 0.00 | 6 | HGG1 |
| 2836470 | −0.18 | −2.17 to 0.23 | 0.19 | 0.14 | 0.00 | 0.00 | 0.23 | 0.00 | 0.00 | 0.00 | −2.17 | 6 | HGG1 |
| 1857044 | 0.61 | 0.00 to 1.36 | 0.71 | 0.67 | 0.49 | 0.82 | 1.36 | 0.92 | 0.00 | 0.00 | 0.50 | 6 | HGG1 |
| 2358261 | 0.46 | 0.00 to 1.47 | 1.47 | 0.00 | 1.21 | 0.00 | 0.55 | 0.93 | 0.00 | 0.00 | 0.00 | 6 | HGG1 |
| 1636015 | 0.11 | 0.00 to 1.34 | 0.58 | 0.49 | 0.46 | 1.02 | 1.34 | 0.73 | 0.00 | 0.00 | 0.00 | 6 | HGG1 |
| 1654437 | 0.47 | 0.00 to 1.37 | 0.72 | 0.67 | 0.53 | 0.00 | 1.37 | 0.93 | 0.00 | 0.00 | 0.00 | 6 | HGG1 |
| 2886955 | −1.76 | −2.29 to −1.43 | −1.43 | −1.43 | −1.47 | −2.08 | −2.29 | −2.19 | −1.46 | −1.55 | −1.89 | 7 | HGG1 |
| 5541828 | −2.06 | −2.81 to −1.72 | −1.93 | −1.73 | −1.72 | −2.26 | −2.81 | −2.21 | −1.88 | −1.79 | −2.24 | 7 | HGG1 |
| 560115 | −1.89 | −2.73 to −1.09 | −1.70 | −2.01 | −2.10 | −1.73 | −2.73 | −2.35 | −1.09 | −1.52 | −1.81 | 7 | HGG1 |
| 2912637 | −2.39 | −2.74 to −2.13 | −2.50 | −2.24 | −2.13 | −2.74 | −2.71 | −2.29 | −2.46 | −2.22 | −2.21 | 7 | HGG1 |
| 3031022 | −1.90 | −2.21 to −1.56 | −1.73 | −1.84 | −2.02 | −1.95 | −2.05 | −2.21 | −1.56 | −1.75 | −2.00 | 7 | HGG1 |
| 2042056 | −1.86 | −2.23 to −1.48 | −1.48 | −1.84 | −1.58 | −2.13 | −2.23 | −1.90 | −2.04 | −1.91 | −1.61 | 7 | HGG1 |
| 3975209 | −1.61 | −1.85 to −1.12 | −1.70 | −1.12 | −1.38 | −1.85 | −1.82 | −1.49 | −1.85 | −1.45 | −1.79 | 8 | HGG1 |
| 5047895 | −1.65 | −2.03 to −1.39 | −1.39 | −1.41 | −1.56 | −1.59 | −1.55 | −2.03 | −1.78 | −1.52 | −2.02 | 8 | HGG1 |
| 1619292 | −1.57 | −1.86 to −1.20 | −1.20 | −1.26 | −1.38 | −1.76 | −1.71 | −1.67 | −1.55 | −1.70 | −1.86 | 8 | HGG1 |
| 1890576 | −1.67 | −2.18 to −1.30 | −1.30 | −1.44 | −1.39 | −1.79 | −1.73 | −1.68 | −2.18 | −1.80 | −1.68 | 8 | HGG1 |
| 1876456 | −1.56 | −1.99 to −1.25 | −1.36 | −1.34 | −1.25 | −1.73 | −1.99 | −1.45 | −1.77 | −1.52 | −1.60 | 8 | HGG1 |
| 2874010 | −0.59 | −5.68 to 0.17 | 0.17 | 0.00 | 0.09 | 0.00 | −0.02 | 0.11 | 0.00 | 0.00 | −5.68 | 9 | HGG1 |
| 2252501 | 0.28 | −0.25 to 2.16 | 2.16 | −0.25 | 0.04 | 0.00 | 0.00 | 0.00 | 0.00 | | | 0 | HGG2 |
| 2230608 | 1.23 | 1.00 to 1.45 | 1.29 | 1.13 | 1.00 | 1.26 | 1.45 | 1.19 | 1.25 | | | 0 | HGG2 |
| 1323616 | 1.09 | 0.86 to 1.43 | 1.43 | 1.20 | 0.86 | 1.17 | 1.03 | 1.06 | 0.87 | | | 0 | HGG2 |
| 2667438 | 0.86 | 0.00 to 1.36 | 1.29 | 1.01 | 1.04 | 1.36 | 0.00 | 1.30 | 0.00 | | | 0 | HGG2 |
| 1407125 | 1.55 | 1.33 to 1.83 | 1.83 | 1.71 | 1.49 | 1.52 | 1.62 | 1.33 | 1.35 | | | 0 | HGG2 |
| 1487428 | 0.90 | 0.00 to 1.53 | 1.53 | 1.41 | 0.89 | 1.34 | 0.00 | 1.10 | 0.00 | | | 0 | HGG2 |
| 1547122 | 0.21 | 0.00 to 1.46 | 0.00 | 0.00 | 1.46 | 0.00 | 0.00 | 0.00 | 0.00 | | | 0 | HGG2 |
| 2394990 | 0.98 | 0.00 to 1.39 | 1.39 | 1.34 | 1.00 | 1.28 | 0.00 | 1.13 | 0.73 | | | 0 | HGG2 |
| 2110103 | 0.36 | 0.00 to 2.52 | 2.52 | 0.00 | 0.03 | 0.00 | 0.00 | 0.00 | 0.00 | | | 0 | HGG2 |
| 1709709 | 1.34 | 0.99 to 1.62 | 1.48 | 1.22 | 0.99 | 1.31 | 1.62 | 1.45 | 1.31 | | | 0 | HGG2 |
| 2018315 | 1.33 | 0.00 to 1.79 | 1.70 | 1.45 | 1.29 | 1.56 | 0.00 | 1.79 | 1.49 | | | 0 | HGG2 |
| 1911819 | 1.32 | 0.85 to 1.83 | 1.14 | 0.93 | 0.85 | 1.48 | 1.83 | 1.71 | 1.29 | | | 0 | HGG2 |
| 2021989 | 1.11 | 0.00 to 1.58 | 1.58 | 1.42 | 1.19 | 1.22 | 0.00 | 1.28 | 1.10 | | | 0 | HGG2 |
| 2725369 | 0.84 | 0.45 to 1.46 | 0.67 | 0.67 | 0.45 | 1.06 | 1.46 | 0.76 | 0.78 | | | 0 | HGG2 |
| 2797740 | 0.32 | 0.00 to 2.06 | 2.06 | 0.00 | 0.15 | 0.00 | 0.00 | 0.00 | 0.00 | | | 0 | HGG2 |
| 2837006 | 1.46 | 1.24 to 1.81 | 1.57 | 1.38 | 1.25 | 1.24 | 1.59 | 1.39 | 1.81 | | | 0 | HGG2 |
| 3047143 | 1.10 | 0.84 to 1.35 | 1.25 | 1.13 | 0.84 | 1.11 | 1.35 | 1.09 | 0.91 | | | 0 | HGG2 |
| 757514 | 1.02 | 0.77 to 1.34 | 1.11 | 0.93 | 0.78 | 0.77 | 1.34 | 1.05 | 1.16 | | | 0 | HGG2 |
| 870396 | 1.10 | 0.77 to 1.33 | 1.10 | 0.93 | 0.77 | 1.27 | 1.19 | 1.33 | 1.14 | | | 0 | HGG2 |
| 960604 | 1.23 | 0.00 to 1.70 | 1.55 | 1.48 | 1.13 | 1.40 | 0.00 | 1.33 | 1.70 | | | 0 | HGG2 |
| 2086783 | −0.88 | −1.36 to −0.64 | −0.66 | −0.64 | −0.92 | −1.00 | −0.74 | −0.83 | −1.36 | | | 1 | HGG2 |
| 2294968 | −0.73 | −1.39 to 0.00 | −0.92 | −1.00 | −1.39 | −0.90 | 0.00 | −0.91 | 0.00 | | | 1 | HGG2 |
| 2453558 | −1.22 | −1.39 to −0.99 | −1.39 | −1.17 | −1.39 | −1.07 | −0.99 | −1.33 | −1.17 | | | 1 | HGG2 |
| 2469891 | −1.09 | −1.48 to −0.69 | −0.69 | −0.83 | −1.15 | −1.14 | −1.12 | −1.22 | −1.48 | | | 1 | HGG2 |
| 2703122 | −1.41 | −1.63 to −1.26 | −1.42 | −1.43 | −1.63 | −1.34 | −1.30 | −1.48 | −1.26 | | | 1 | HGG2 |
| 2287703 | −0.99 | −1.34 to −0.76 | −0.76 | −0.82 | −1.07 | −0.98 | −0.89 | −1.11 | −1.34 | | | 1 | HGG2 |
| 2794866 | −1.10 | −1.36 to −0.86 | −1.31 | −1.11 | −1.36 | −0.86 | −1.01 | −1.18 | −0.89 | | | 1 | HGG2 |
| 1616048 | −0.87 | −1.39 to 0.00 | 0.00 | −1.35 | −1.39 | −1.12 | 0.00 | −1.20 | −1.03 | | | 1 | HGG2 |
| 1662870 | −0.76 | −1.38 to 0.00 | −1.38 | −0.89 | −1.13 | −0.73 | 0.00 | −0.55 | −0.64 | | | 1 | HGG2 |
| 1753283 | −1.12 | −1.60 to 0.00 | −1.60 | −1.42 | −1.60 | −0.99 | 0.00 | −1.24 | −1.00 | | | 1 | HGG2 |
| 3100048 | −0.81 | −1.46 to 0.03 | −0.17 | −1.11 | −1.38 | 0.03 | −0.41 | −1.14 | −1.46 | | | 1 | HGG2 |
| 3421730 | −0.88 | −1.38 to −0.39 | −0.44 | −1.00 | −1.38 | −0.70 | −0.39 | −1.23 | −0.98 | | | 1 | HGG2 |

TABLE 8-continued

| Clone ID | Ave DE t/Beclo | Range | mean DE t/Beclo 1 μM, 1 hr | mean DE t/Beclo 1 μM, 3 hr | mean DE t/Beclo 1 μM, 6 hr | mean DE t/Beclo 10 μM, 1 hr | mean DE t/Beclo 10 μM, 3 hr | mean DE t/Beclo 10 μM, 6 hr | mean DE t/Beclo 100 μM, 1 hr | mean DE t/Beclo 100 μM, 3 hr | mean DE t/Beclo 100 μM, 1 hr | Cluster | GEM |
|---|---|---|---|---|---|---|---|---|---|---|---|---|---|
| 2285181 | −0.88 | −1.37 to −0.69 | −0.72 | −0.69 | −1.00 | −0.74 | −0.72 | −0.95 | −1.37 | | | 1 | HGG2 |
| 1988774 | −1.11 | −1.64 to −0.60 | −0.61 | −1.45 | −1.64 | −0.60 | −0.95 | −1.33 | −1.22 | | | 1 | HGG2 |
| 2095329 | −0.99 | −1.48 to −0.36 | −0.36 | −0.83 | −1.03 | −1.11 | −1.02 | −1.09 | −1.48 | | | 1 | HGG2 |
| 1988540 | 1.75 | 1.39 to 2.09 | 1.95 | 1.92 | 1.54 | 2.09 | 1.89 | 1.39 | 1.51 | | | 2 | HGG2 |
| 1326255 | 2.69 | 1.99 to 3.28 | 3.10 | 3.28 | 1.99 | 2.98 | 2.58 | 2.04 | 2.85 | | | 2 | HGG2 |
| 2124056 | 2.47 | 2.09 to 2.66 | 2.59 | 2.57 | 2.41 | 2.46 | 2.66 | 2.09 | 2.49 | | | 2 | HGG2 |
| 3206352 | 1.75 | 1.30 to 2.02 | 1.75 | 1.75 | 1.30 | 1.73 | 2.02 | 1.84 | 1.86 | | | 2 | HGG2 |
| 660142 | 2.50 | 0.00 to 3.47 | 2.96 | 2.68 | 2.73 | 2.66 | 0.00 | 3.01 | 3.47 | | | 3 | HGG2 |
| 2234266 | 2.49 | 0.00 to 3.35 | 3.35 | 2.98 | 2.78 | 3.07 | 0.00 | 2.79 | 2.44 | | | 3 | HGG2 |
| 2544622 | 2.72 | 0.00 to 3.47 | 3.47 | 3.26 | 2.87 | 3.26 | 0.00 | 3.13 | 3.06 | | | 3 | HGG2 |
| 1316801 | 1.96 | 0.00 to 2.68 | 2.38 | 2.14 | 1.91 | 2.14 | 0.00 | 2.48 | 2.68 | | | 3 | HGG2 |
| 626471 | 1.40 | 0.00 to 2.17 | 2.07 | 1.93 | 1.76 | 1.85 | 0.00 | 2.17 | 0.00 | | | 4 | HGG2 |
| 1303862 | 2.01 | 0.00 to 3.09 | 3.09 | 2.96 | 2.27 | 2.86 | 0.00 | 2.88 | 0.00 | | | 4 | HGG2 |
| 1961617 | 1.99 | 0.00 to 2.92 | 2.85 | 2.56 | 2.66 | 2.90 | 0.00 | 2.92 | 0.00 | | | 4 | HGG2 |
| 2226309 | 1.28 | 0.00 to 3.19 | 3.19 | 2.90 | 2.88 | 0.00 | 0.00 | 0.00 | 0.00 | | | 5 | HGG2 |
| 1926934 | 0.97 | 0.00 to 2.39 | 2.39 | 2.14 | 2.25 | 0.00 | 0.00 | 0.00 | 0.00 | | | 5 | HGG2 |
| 654246 | −0.95 | −1.42 to 0.00 | −0.90 | −1.13 | −1.42 | −0.81 | −1.05 | −1.37 | 0.00 | | | 0 | HGG3 |
| 4070403 | −1.00 | −1.35 to −0.53 | −0.88 | −0.93 | −1.18 | −1.07 | −1.08 | −1.35 | −0.53 | | | 0 | HGG3 |
| 4223734 | −0.38 | −2.70 to 0.12 | −2.70 | 0.00 | −0.10 | 0.00 | 0.00 | 0.12 | 0.00 | | | 0 | HGG3 |
| 1911443 | −0.97 | −1.94 to −0.41 | −0.44 | −1.00 | −1.60 | −0.69 | −0.68 | −1.94 | −0.41 | | | 0 | HGG3 |
| 3778404 | −1.61 | −2.05 to −0.72 | −1.35 | −1.59 | −2.04 | −1.58 | −2.05 | −1.97 | −0.72 | | | 0 | HGG3 |
| 4289557 | −1.91 | −2.31 to −1.12 | −1.64 | −1.99 | −2.31 | −1.90 | −2.11 | −2.28 | −1.12 | | | 0 | HGG3 |
| 4715924 | −1.12 | −1.43 to −0.96 | −0.96 | −0.98 | −1.27 | −1.09 | −1.43 | −1.17 | −0.97 | | | 0 | HGG3 |
| 4894508 | −0.93 | −1.50 to −0.20 | −0.90 | −1.15 | −1.50 | −0.98 | −0.70 | −1.11 | −0.20 | | | 0 | HGG3 |
| 5089438 | −1.03 | −1.39 to 0.00 | −0.91 | −1.39 | −1.33 | −1.25 | −1.11 | −1.18 | 0.00 | | | 0 | HGG3 |
| 2908777 | −0.32 | −2.54 to 0.28 | −2.54 | 0.00 | 0.28 | 0.00 | 0.00 | 0.00 | 0.00 | | | 0 | HGG3 |
| 5091002 | −1.13 | −1.44 to −0.72 | −0.72 | −1.13 | −1.09 | −1.16 | −1.44 | −1.28 | −1.07 | | | 0 | HGG3 |
| 5166479 | −1.42 | −1.97 to −0.94 | −0.94 | −1.51 | −1.97 | −1.21 | −1.37 | −1.76 | −1.16 | | | 0 | HGG3 |
| 5309371 | −1.07 | −1.49 to −0.78 | −0.83 | −1.33 | −1.15 | −0.97 | −0.78 | −1.49 | −0.95 | | | 0 | HGG3 |
| 5427710 | −1.99 | −2.36 to −1.26 | −1.94 | −2.20 | −2.36 | −1.96 | −1.93 | −2.26 | −1.26 | | | 0 | HGG3 |
| 4312603 | −0.30 | −2.12 to 0.00 | −2.12 | 0.00 | 0.00 | 0.00 | 0.00 | 0.00 | 0.00 | | | 0 | HGG3 |
| 3084204 | −1.51 | −1.92 to −0.89 | −1.17 | −1.55 | −1.68 | −1.48 | −1.92 | −1.89 | −0.89 | | | 0 | HGG3 |
| 3090808 | −0.89 | −1.35 to −0.31 | −0.76 | −0.71 | −1.02 | −0.85 | −1.35 | −1.20 | −0.31 | | | 0 | HGG3 |
| 3097624 | −1.31 | −1.61 to −0.87 | −0.87 | −1.27 | −1.45 | −1.37 | −1.61 | −1.61 | −1.14 | | | 0 | HGG3 |
| 3120209 | −1.53 | −2.06 to −0.99 | −1.35 | −1.47 | −0.99 | −1.98 | −1.68 | −1.19 | −2.06 | | | 0 | HGG3 |
| 3125211 | −1.16 | −1.40 to −0.81 | −0.99 | −1.01 | −1.40 | −1.31 | −1.30 | −1.35 | −0.81 | | | 0 | HGG3 |
| 3135460 | −1.22 | −1.96 to −0.45 | −0.84 | −0.95 | −1.96 | −1.08 | −1.36 | −1.91 | −0.45 | | | 0 | HGG3 |
| 5573549 | −1.46 | −1.70 to −1.12 | −1.12 | −1.16 | −1.49 | −1.53 | −1.70 | −1.66 | −1.57 | | | 0 | HGG3 |
| 4298848 | −0.19 | −1.36 to 0.00 | 0.00 | 0.00 | −1.36 | 0.00 | 0.00 | 0.00 | 0.00 | | | 0 | HGG3 |
| 1251065 | 1.32 | 1.04 to 1.68 | 1.23 | 1.22 | 1.04 | 1.40 | 1.68 | 1.23 | 1.43 | | | 1 | HGG3 |
| 3974247 | 1.40 | 1.12 to 1.90 | 1.12 | 1.37 | 1.15 | 1.25 | 1.90 | 1.60 | 1.42 | | | 1 | HGG3 |
| 3495173 | 1.28 | 1.10 to 1.49 | 1.39 | 1.44 | 1.25 | 1.10 | 1.49 | 1.15 | 1.13 | | | 1 | HGG3 |
| 4091186 | 0.94 | 0.67 to 1.46 | 1.02 | 0.92 | 0.96 | 0.68 | 1.46 | 0.90 | 0.67 | | | 1 | HGG3 |
| 3960194 | 1.00 | 0.00 to 1.45 | 1.33 | 1.23 | 0.84 | 1.36 | 1.45 | 0.83 | 0.00 | | | 1 | HGG3 |
| 2871076 | 1.37 | 0.99 to 2.10 | 1.05 | 1.24 | 0.99 | 1.45 | 2.10 | 1.64 | 1.08 | | | 1 | HGG3 |
| 2972013 | 1.51 | 1.28 to 1.76 | 1.34 | 1.50 | 1.28 | 1.53 | 1.76 | 1.47 | 1.66 | | | 1 | HGG3 |
| 3034889 | 1.37 | 1.10 to 1.79 | 1.30 | 1.27 | 1.10 | 1.41 | 1.79 | 1.22 | 1.52 | | | 1 | HGG3 |
| 4215334 | 1.13 | 0.75 to 1.51 | 1.08 | 1.13 | 0.75 | 1.04 | 1.51 | 1.24 | 1.17 | | | 1 | HGG3 |
| 3973687 | 1.23 | 1.08 to 1.56 | 1.12 | 1.14 | 1.08 | 1.26 | 1.56 | 1.16 | 1.28 | | | 1 | HGG3 |
| 5266376 | 1.17 | 0.74 to 1.61 | 1.61 | 1.07 | 0.92 | 1.24 | 1.56 | 1.03 | 0.74 | | | 1 | HGG3 |
| 5293028 | 1.25 | 0.98 to 1.42 | 1.34 | 1.42 | 1.06 | 1.40 | 1.41 | 1.13 | 0.98 | | | 1 | HGG3 |
| 5322365 | 1.48 | 1.25 to 1.78 | 1.51 | 1.42 | 1.25 | 1.46 | 1.78 | 1.45 | 1.48 | | | 1 | HGG3 |
| 4855265 | 1.00 | 0.82 to 1.45 | 0.90 | 1.00 | 0.82 | 0.95 | 1.45 | 1.04 | 0.84 | | | 1 | HGG3 |
| 4863677 | 1.09 | 0.79 to 1.59 | 1.04 | 0.85 | 0.79 | 1.05 | 1.59 | 1.10 | 1.25 | | | 1 | HGG3 |
| 554654 | 1.20 | 0.71 to 1.75 | 1.14 | 1.21 | 0.71 | 1.38 | 1.75 | 1.34 | 0.85 | | | 1 | HGG3 |
| 597555 | 0.96 | 0.00 to 1.47 | 1.08 | 1.03 | 0.88 | 1.18 | 1.47 | 1.11 | 0.00 | | | 1 | HGG3 |
| 615776 | 1.01 | 0.59 to 1.45 | 0.81 | 0.99 | 0.59 | 1.00 | 1.45 | 1.21 | 1.00 | | | 1 | HGG3 |
| 668460 | 1.23 | 0.85 to 1.72 | 1.16 | 1.02 | 0.85 | 1.29 | 1.72 | 1.17 | 1.40 | | | 1 | HGG3 |
| 748477 | 1.49 | 1.10 to 2.07 | 1.54 | 1.22 | 1.10 | 1.48 | 2.07 | 1.44 | 1.55 | | | 1 | HGG3 |
| 4402555 | 2.23 | 1.94 to 2.75 | 1.94 | 2.19 | 1.96 | 2.17 | 2.75 | 2.23 | 2.37 | | | 2 | HGG3 |
| 3158828 | 1.92 | 1.62 to 2.58 | 1.71 | 1.86 | 1.62 | 1.86 | 2.58 | 2.08 | 1.72 | | | 2 | HGG3 |
| 5512044 | 1.89 | 1.61 to 2.47 | 1.61 | 1.74 | 1.66 | 1.79 | 2.47 | 2.01 | 1.93 | | | 2 | HGG3 |
| 5102731 | 1.59 | 0.00 to 2.16 | 1.85 | 1.95 | 1.69 | 1.61 | 2.16 | 1.85 | 0.00 | | | 2 | HGG3 |
| 4253809 | 2.02 | 1.76 to 2.31 | 2.19 | 2.05 | 1.83 | 2.08 | 2.31 | 1.93 | 1.76 | | | 2 | HGG3 |
| 5266015 | 2.38 | 2.03 to 2.79 | 2.27 | 2.24 | 2.03 | 2.29 | 2.79 | 2.39 | 2.64 | | | 2 | HGG3 |
| 1786554 | 1.58 | 1.42 to 1.89 | 1.54 | 1.61 | 1.50 | 1.51 | 1.89 | 1.42 | 1.60 | | | 2 | HGG3 |
| 621543 | 1.65 | 0.00 to 2.60 | 1.73 | 1.74 | 1.75 | 1.66 | 2.60 | 2.04 | 0.00 | | | 2 | HGG3 |
| 4912315 | 1.85 | 0.00 to 2.39 | 2.08 | 2.39 | 1.93 | 2.36 | 2.00 | 2.16 | 0.00 | | | 2 | HGG3 |
| 2343348 | 1.89 | 1.54 to 2.37 | 1.87 | 1.67 | 1.54 | 1.84 | 2.37 | 1.85 | 2.07 | | | 2 | HGG3 |
| 2545486 | 1.48 | 0.00 to 1.99 | 1.32 | 1.95 | 1.52 | 1.92 | 1.99 | 1.64 | 0.00 | | | 2 | HGG3 |
| 517374 | 0.40 | 0.00 to 1.48 | 1.33 | 0.00 | 1.48 | 0.00 | 0.00 | 0.00 | 0.00 | | | 3 | HGG3 |
| 2364257 | 0.37 | 0.00 to 2.62 | 0.00 | 0.00 | 2.62 | 0.00 | 0.00 | 0.00 | 0.00 | | | 3 | HGG3 |
| 3068978 | 0.65 | 0.00 to 2.31 | 2.31 | 0.00 | 2.26 | 0.00 | 0.00 | 0.00 | 0.00 | | | 3 | HGG3 |

TABLE 8-continued

| Clone ID | Ave DE t/Beclo | Range | mean DE t/Beclo 1 μM, 1 hr | mean DE t/Beclo 1 μM, 3 hr | mean DE t/Beclo 1 μM, 6 hr | mean DE t/Beclo 10 μM, 1 hr | mean DE t/Beclo 10 μM, 3 hr | mean DE t/Beclo 10 μM, 6 hr | mean DE t/Beclo 100 μM, 1 hr | mean DE t/Beclo 100 μM, 3 hr | mean DE t/Beclo 100 μM, 1 hr | Cluster | GEM |
|---|---|---|---|---|---|---|---|---|---|---|---|---|---|
| 3528232 | 0.38 | 0.00 to 1.36 | 1.32 | 0.00 | 1.36 | 0.00 | 0.00 | 0.00 | 0.00 | | | 3 | HGG3 |
| 4222957 | 0.26 | −0.15 to 1.76 | −0.15 | 1.76 | 0.12 | 0.19 | −0.11 | 0.14 | −0.11 | | | 3 | HGG3 |
| 4232507 | 0.41 | 0.00 to 1.49 | 1.36 | 0.00 | 1.49 | 0.00 | 0.00 | 0.00 | 0.00 | | | 3 | HGG3 |
| 4508879 | 0.47 | 0.00 to 1.43 | 0.92 | 0.00 | 1.43 | 0.93 | 0.00 | 0.00 | 0.00 | | | 3 | HGG3 |
| 699113 | 0.65 | 0.00 to 2.37 | 2.21 | 0.00 | 2.37 | 0.00 | 0.00 | 0.00 | 0.00 | | | 3 | HGG3 |
| 1560380 | 0.43 | 0.00 to 1.59 | 1.59 | 0.00 | 1.43 | 0.00 | 0.00 | 0.00 | 0.00 | | | 3 | HGG3 |
| 3915205 | 1.23 | 0.00 to 5.29 | 0.46 | 0.00 | 0.00 | 5.29 | 0.00 | 2.89 | 0.00 | | | 4 | HGG3 |
| 872017 | 1.30 | 0.00 to 1.93 | 1.74 | 1.93 | 1.66 | 1.84 | 0.00 | 1.90 | 0.00 | | | 4 | HGG3 |
| 3074113 | 1.49 | 0.00 to 2.22 | 2.15 | 2.09 | 1.78 | 2.22 | 0.00 | 2.16 | 0.00 | | | 4 | HGG3 |
| 5508135 | 1.19 | 0.00 to 1.89 | 1.61 | 1.89 | 1.54 | 1.74 | 0.00 | 1.55 | 0.00 | | | 4 | HGG3 |
| 3957354 | 2.35 | 0.00 to 3.55 | 3.09 | 3.46 | 3.21 | 3.55 | 0.00 | 3.13 | 0.00 | | | 4 | HGG3 |
| 3172265 | 3.56 | 3.32 to 3.84 | 3.84 | 3.67 | 3.41 | 3.59 | 3.69 | 3.40 | 3.32 | | | 5 | HGG3 |
| 3069190 | 3.98 | 3.71 to 4.32 | 4.00 | 3.97 | 3.90 | 3.95 | 4.32 | 3.97 | 3.71 | | | 5 | HGG3 |
| 2370756 | 0.58 | −0.04 to 3.74 | 0.13 | 0.00 | −0.04 | 0.11 | 0.00 | 0.12 | 3.74 | | | 6 | HGG3 |
| 2106010 | 1.52 | 1.17 to 1.95 | 1.62 | 1.36 | 1.17 | 1.65 | 1.95 | 1.34 | | | | 0 | HGG4 |
| 1365045 | 1.75 | 1.43 to 2.08 | 1.83 | 1.66 | 1.43 | 1.84 | 2.08 | 1.62 | | | | 0 | HGG4 |
| 409209 | 1.10 | 0.82 to 1.37 | 1.24 | 1.16 | 0.82 | 1.08 | 1.37 | 0.93 | | | | 0 | HGG4 |
| 4077648 | 0.99 | 0.62 to 1.40 | 1.04 | 0.89 | 0.62 | 1.04 | 1.40 | 0.94 | | | | 0 | HGG4 |
| 1425150 | 1.03 | 0.78 to 1.35 | 1.05 | 1.01 | 0.78 | 0.96 | 1.35 | 1.02 | | | | 0 | HGG4 |
| 3522739 | 1.16 | 0.00 to 1.56 | 1.43 | 0.00 | 0.96 | 1.56 | 1.56 | 1.46 | | | | 0 | HGG4 |
| 1730026 | 1.20 | 0.92 to 1.39 | 1.38 | 1.14 | 0.92 | 1.39 | 1.35 | 1.05 | | | | 0 | HGG4 |
| 3016137 | 1.28 | 0.68 to 1.91 | 0.93 | 0.99 | 0.68 | 1.68 | 1.91 | 1.48 | | | | 0 | HGG4 |
| 2669871 | 1.07 | 0.75 to 1.35 | 1.35 | 1.17 | 1.14 | 1.14 | 0.75 | 0.87 | | | | 0 | HGG4 |
| 1913334 | 1.51 | 1.30 to 1.79 | 1.65 | 1.30 | 1.31 | 1.63 | 1.79 | 1.41 | | | | 0 | HGG4 |
| 1951845 | 1.01 | 0.00 to 1.42 | 1.42 | 0.00 | 1.00 | 1.24 | 1.33 | 1.05 | | | | 0 | HGG4 |
| 2619275 | 1.25 | 1.06 to 1.46 | 1.44 | 1.21 | 1.06 | 1.23 | 1.46 | 1.08 | | | | 0 | HGG4 |
| 2430165 | 1.04 | 0.00 to 1.99 | 0.00 | 0.00 | 0.74 | 1.99 | 1.91 | 1.58 | | | | 0 | HGG4 |
| 1965856 | 1.51 | 1.35 to 1.65 | 1.62 | 1.51 | 1.43 | 1.49 | 1.65 | 1.35 | | | | 0 | HGG4 |
| 2006043 | 1.10 | 0.91 to 1.38 | 1.20 | 1.01 | 0.91 | 1.12 | 1.38 | 0.95 | | | | 0 | HGG4 |
| 2007730 | 1.21 | 0.98 to 1.37 | 1.29 | 1.09 | 0.98 | 1.37 | 1.37 | 1.14 | | | | 0 | HGG4 |
| 2110482 | 1.59 | 1.38 to 1.79 | 1.79 | 1.48 | 1.38 | 1.61 | 1.75 | 1.52 | | | | 0 | HGG4 |
| 2408333 | 1.32 | 1.08 to 1.53 | 1.53 | 1.42 | 1.16 | 1.38 | 1.36 | 1.08 | | | | 0 | HGG4 |
| 2062085 | 1.22 | 0.96 to 1.40 | 1.40 | 1.27 | 1.16 | 1.21 | 1.32 | 0.96 | | | | 0 | HGG4 |
| 434751 | 1.59 | 1.28 to 1.82 | 1.75 | 1.57 | 1.46 | 1.64 | 1.82 | 1.28 | | | | 0 | HGG4 |
| 509839 | 1.62 | 1.32 to 1.82 | 1.75 | 1.53 | 1.32 | 1.75 | 1.82 | 1.56 | | | | 0 | HGG4 |
| 5101167 | 1.18 | 0.85 to 1.58 | 1.20 | 1.00 | 0.85 | 1.58 | 1.34 | 1.12 | | | | 0 | HGG4 |
| 5690026 | 1.31 | 1.01 to 1.60 | 1.55 | 1.29 | 1.01 | 1.24 | 1.60 | 1.15 | | | | 0 | HGG4 |
| 2410066 | 1.01 | 0.00 to 1.73 | 1.61 | 0.00 | 1.29 | 1.39 | 1.73 | 0.00 | | | | 1 | HGG4 |
| 2724032 | 0.68 | 0.00 to 4.06 | 0.00 | 0.00 | 4.06 | 0.00 | 0.00 | 0.00 | | | | 1 | HGG4 |
| 3149570 | 0.95 | 0.00 to 1.70 | 1.52 | 0.00 | 1.06 | 1.42 | 1.70 | 0.00 | | | | 1 | HGG4 |
| 1329625 | 0.35 | 0.00 to 1.40 | 1.40 | 0.00 | 0.71 | 0.00 | 0.00 | 0.00 | | | | 1 | HGG4 |
| 2013251 | 0.25 | 0.00 to 1.50 | 0.00 | 0.00 | 1.50 | 0.00 | 0.00 | 0.00 | | | | 1 | HGG4 |
| 2267466 | 1.08 | 0.00 to 1.71 | 1.65 | 0.00 | 1.53 | 1.56 | 1.71 | 0.00 | | | | 1 | HGG4 |
| 2405487 | 0.98 | 0.00 to 1.68 | 1.54 | 0.00 | 1.17 | 1.50 | 1.68 | 0.00 | | | | 1 | HGG4 |
| 3191030 | 2.47 | 2.22 to 2.76 | 2.59 | 2.22 | 2.22 | 2.63 | 2.76 | 2.37 | | | | 2 | HGG4 |
| 1964758 | 2.32 | 2.11 to 2.57 | 2.57 | 2.35 | 2.12 | 2.26 | 2.52 | 2.11 | | | | 2 | HGG4 |
| 2581075 | 3.52 | 3.23 to 3.92 | 3.62 | 3.45 | 3.27 | 3.64 | 3.92 | 3.23 | | | | 2 | HGG4 |
| 1370137 | 2.71 | 2.39 to 2.91 | 2.91 | 2.60 | 2.39 | 2.83 | 2.85 | 2.65 | | | | 2 | HGG4 |
| 2278772 | 2.48 | 2.03 to 2.71 | 2.71 | 2.66 | 2.66 | 2.37 | 2.45 | 2.03 | | | | 2 | HGG4 |
| 2786442 | −1.53 | −1.92 to −1.24 | −1.52 | −1.30 | −1.24 | −1.84 | −1.92 | −1.38 | | | | 3 | HGG4 |
| 1857850 | −2.14 | −2.95 to −1.53 | −2.18 | −1.77 | −2.08 | −2.36 | −2.95 | −1.53 | | | | 3 | HGG4 |
| 3042227 | −1.72 | −2.03 to −1.41 | −1.55 | −1.41 | −1.74 | −1.80 | −1.81 | −2.03 | | | | 3 | HGG4 |
| 1953051 | −1.33 | −1.59 to −0.95 | −1.16 | −0.95 | −1.29 | −1.41 | −1.59 | −1.59 | | | | 3 | HGG4 |
| 1449819 | −1.30 | −2.37 to −0.40 | −0.40 | −1.33 | −2.15 | −0.45 | −1.10 | −2.37 | | | | 4 | HGG4 |
| 1383138 | −1.06 | −1.43 to −0.74 | −0.74 | −1.04 | −1.10 | −0.80 | −1.25 | −1.43 | | | | 4 | HGG4 |
| 2055569 | −0.96 | −1.57 to −0.45 | −0.45 | −1.10 | −1.43 | −0.60 | −0.59 | −1.57 | | | | 4 | HGG4 |
| 1876829 | −1.00 | −1.35 to −0.68 | −0.80 | −0.68 | −0.98 | −1.35 | −1.07 | −1.14 | | | | 4 | HGG4 |

TABLE 9

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 1944123 | 1.27 | 0.00 to 1.59 | 1.15 | 1.00 | 1.25 | 1.34 | 1.30 | 1.59 | 1.34 | 1.19 | 1.24 | 0 | HGG1 |
| 1210839 | 1.29 | 0.90 to 1.58 | 1.40 | 0.90 | 1.19 | 1.47 | 1.31 | 1.58 | 1.48 | 1.18 | 1.07 | 0 | HGG1 |
| 1995520 | 1.09 | 0.00 to 1.50 | 0.00 | 0.85 | 1.27 | 1.23 | 1.35 | 1.50 | 1.37 | 1.28 | 0.96 | 0 | HGG1 |
| 1268277 | 1.16 | 0.86 to 1.51 | 1.20 | 0.86 | 1.30 | 1.34 | 1.09 | 1.51 | 1.20 | 0.98 | 0.98 | 0 | HGG1 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 1995767 | 1.00 | 0.61 to 1.38 | 0.87 | 0.61 | 0.84 | 0.84 | 1.11 | 1.38 | 1.35 | 0.84 | 1.14 | 0 | HGG1 |
| 129775 | 0.97 | 0.56 to 1.46 | 0.81 | 0.56 | 0.79 | 0.87 | 1.08 | 1.46 | 1.15 | 0.86 | 1.14 | 0 | HGG1 |
| 4377432 | 1.13 | 0.83 to 1.45 | 1.07 | 0.84 | 1.35 | 1.19 | 1.15 | 1.45 | 1.23 | 0.83 | 1.09 | 0 | HGG1 |
| 4289063 | 1.09 | 0.83 to 1.43 | 0.99 | 0.83 | 1.11 | 1.19 | 1.19 | 1.43 | 1.19 | 1.04 | 0.87 | 0 | HGG1 |
| 4286760 | 1.08 | 0.64 to 1.50 | 1.00 | 1.50 | 1.25 | 1.02 | 1.15 | 0.77 | 0.64 | 1.47 | 0.93 | 0 | HGG1 |
| 2459765 | 1.23 | 0.83 to 1.62 | 1.20 | 0.83 | 1.00 | 1.09 | 1.39 | 1.62 | 1.46 | 1.27 | 1.26 | 0 | HGG1 |
| 419492 | 1.07 | 0.78 to 1.33 | 0.86 | 0.78 | 0.94 | 1.07 | 0.99 | 1.33 | 1.22 | 1.21 | 1.18 | 0 | HGG1 |
| 4089755 | 1.19 | 0.82 to 1.57 | 1.19 | 0.82 | 1.22 | 1.18 | 1.34 | 1.22 | 1.20 | 1.57 | 1.02 | 0 | HGG1 |
| 139949 | 1.22 | 0.83 to 1.70 | 1.08 | 0.83 | 0.91 | 1.30 | 1.15 | 1.50 | 1.70 | 1.30 | 1.17 | 0 | HGG1 |
| 371201 | 1.20 | 0.78 to 1.60 | 1.05 | 0.90 | 1.06 | 1.30 | 1.19 | 1.60 | 1.53 | 0.78 | 1.36 | 0 | HGG1 |
| 3057272 | 0.99 | 0.69 to 1.52 | 0.96 | 0.69 | 0.80 | 0.83 | 0.97 | 1.07 | 1.12 | 0.91 | 1.52 | 0 | HGG1 |
| 3687607 | 1.05 | 0.76 to 1.40 | 0.94 | 0.76 | 0.94 | 1.02 | 1.09 | 1.40 | 1.34 | 0.93 | 1.05 | 0 | HGG1 |
| 4021009 | 1.25 | 1.02 to 1.59 | 1.21 | 1.02 | 1.32 | 1.33 | 1.33 | 1.59 | 1.38 | 1.06 | 1.05 | 0 | HGG1 |
| 2891601 | 1.04 | 0.69 to 1.51 | 1.07 | 0.82 | 0.91 | 0.69 | 1.02 | 1.17 | 1.51 | 1.05 | 1.15 | 0 | HGG1 |
| 3606947 | 1.05 | 0.62 to 1.52 | 0.92 | 0.62 | 0.84 | 0.85 | 0.99 | 1.52 | 1.46 | 1.11 | 1.11 | 0 | HGG1 |
| 3566383 | 1.09 | 0.92 to 1.38 | 1.38 | 0.92 | 0.92 | 1.05 | 1.04 | 1.19 | 1.19 | 1.05 | 1.07 | 0 | HGG1 |
| 1573840 | 0.90 | 0.52 to 1.37 | 0.87 | 0.52 | 0.73 | 0.78 | 0.99 | 1.25 | 1.37 | 0.76 | 0.85 | 0 | HGG1 |
| 4018288 | 1.10 | 0.79 to 1.55 | 1.15 | 0.79 | 1.03 | 1.16 | 1.13 | 1.55 | 1.37 | 0.83 | 0.88 | 0 | HGG1 |
| 2830240 | 1.17 | 0.73 to 1.51 | 1.00 | 0.73 | 1.24 | 1.17 | 1.21 | 1.51 | 1.27 | 1.22 | 1.17 | 0 | HGG1 |
| 1609387 | 1.22 | 0.87 to 1.69 | 1.14 | 0.87 | 1.21 | 1.36 | 1.27 | 1.69 | 1.45 | 1.05 | 0.91 | 0 | HGG1 |
| 1610828 | 1.25 | 1.01 to 1.46 | 1.20 | 1.06 | 1.36 | 1.41 | 1.24 | 1.46 | 1.33 | 1.17 | 1.01 | 0 | HGG1 |
| 2636759 | 0.93 | 0.51 to 1.49 | 0.80 | 0.51 | 0.94 | 0.90 | 1.02 | 1.49 | 1.27 | 0.70 | 0.76 | 0 | HGG1 |
| 400654 | 1.15 | 0.79 to 1.35 | 1.19 | 0.79 | 1.24 | 1.10 | 1.21 | 1.28 | 1.35 | 0.99 | 1.21 | 0 | HGG1 |
| 2148703 | 1.14 | 0.71 to 1.42 | 1.08 | 0.71 | 1.27 | 1.13 | 1.15 | 1.42 | 1.27 | 1.08 | 1.14 | 0 | HGG1 |
| 3075994 | 1.24 | 0.89 to 1.65 | 1.31 | 0.89 | 1.29 | 1.42 | 1.25 | 1.65 | 1.35 | 0.99 | 1.02 | 0 | HGG1 |
| 622565 | 1.20 | 1.02 to 1.40 | 1.26 | 1.09 | 1.28 | 1.40 | 1.16 | 1.38 | 1.15 | 1.02 | 1.07 | 0 | HGG1 |
| 2173002 | 0.99 | 0.75 to 1.36 | 1.07 | 0.75 | 0.88 | 1.02 | 0.97 | 1.36 | 1.09 | 0.80 | 0.93 | 0 | HGG1 |
| 5521873 | 1.19 | 0.79 to 1.56 | 1.35 | 0.79 | 1.14 | 1.17 | 1.17 | 1.25 | 1.23 | 1.56 | 1.05 | 0 | HGG1 |
| 5398701 | 1.09 | 0.45 to 1.71 | 1.27 | 1.19 | 1.06 | 0.72 | 1.16 | 0.45 | 1.00 | 1.71 | 1.22 | 0 | HGG1 |
| 2311213 | 1.04 | 0.56 to 1.37 | 0.98 | 0.56 | 0.82 | 0.84 | 1.15 | 1.19 | 1.37 | 1.12 | 1.36 | 0 | HGG1 |
| 5098879 | 1.10 | 0.67 to 1.69 | 1.09 | 0.67 | 1.03 | 1.08 | 1.12 | 1.69 | 1.49 | 0.85 | 0.90 | 0 | HGG1 |
| 1756875 | 1.27 | 0.00 to 1.91 | 0.00 | 1.07 | 1.38 | 1.39 | 1.39 | 1.91 | 1.83 | 1.28 | 1.22 | 0 | HGG1 |
| 4978708 | 1.31 | 0.99 to 1.50 | 1.38 | 0.99 | 1.37 | 1.42 | 1.23 | 1.49 | 1.50 | 1.23 | 1.18 | 0 | HGG1 |
| 494905 | 0.91 | 0.36 to 1.37 | 0.80 | 0.36 | 0.84 | 0.87 | 1.07 | 1.37 | 1.20 | 0.79 | 0.85 | 0 | HGG1 |
| 4554722 | 1.13 | 0.81 to 1.36 | 1.23 | 0.81 | 1.17 | 1.12 | 1.15 | 1.36 | 1.24 | 1.00 | 1.09 | 0 | HGG1 |
| 1888260 | 1.18 | 0.85 to 1.59 | 1.21 | 0.85 | 1.07 | 1.22 | 1.25 | 1.59 | 1.43 | 1.10 | 0.93 | 0 | HGG1 |
| 3770530 | −0.89 | −1.33 to −0.09 | −1.16 | −0.62 | −0.81 | −1.33 | −0.80 | −1.15 | −1.25 | −0.09 | −0.84 | 1 | HGG1 |
| 3715059 | −0.66 | −1.44 to −0.23 | −0.23 | −0.52 | −1.07 | −0.39 | −0.52 | −1.44 | −0.28 | −0.38 | −1.07 | 1 | HGG1 |
| 1284155 | −1.10 | −1.80 to 0.00 | −0.65 | −1.05 | −1.16 | −0.86 | −1.08 | −1.80 | −1.80 | −1.47 | 0.00 | 1 | HGG1 |
| 2382190 | −0.95 | −1.38 to 0.00 | −1.13 | −0.90 | −1.38 | −1.03 | −1.00 | −1.33 | −0.79 | −0.96 | 0.00 | 1 | HGG1 |
| 2831351 | −0.87 | −1.45 to −0.47 | −0.65 | −0.55 | −0.74 | −0.95 | −0.91 | −1.45 | −1.23 | −0.47 | −0.84 | 1 | HGG1 |
| 2927486 | −0.90 | −1.67 to −0.56 | −0.71 | −0.60 | −1.05 | −0.56 | −0.69 | −1.67 | −0.75 | −0.76 | −1.34 | 1 | HGG1 |
| 2864790 | −1.00 | −1.51 to −0.77 | −0.77 | −0.96 | −1.01 | −0.82 | −1.00 | −1.51 | −1.13 | −0.87 | −0.96 | 1 | HGG1 |
| 1398105 | −0.68 | −1.33 to −0.28 | −0.46 | −0.60 | −0.71 | −0.68 | −0.55 | −1.33 | −0.65 | −0.28 | −0.82 | 1 | HGG1 |
| 2811404 | −0.92 | −1.39 to −0.68 | −0.75 | −0.70 | −0.73 | −0.68 | −0.83 | −1.39 | −1.37 | −0.87 | −0.95 | 1 | HGG1 |
| 3616233 | −0.86 | −1.37 to −0.60 | −0.60 | −0.65 | −0.91 | −0.82 | −0.90 | −1.37 | −0.97 | −0.66 | −0.82 | 1 | HGG1 |
| 3497137 | −0.88 | −1.34 to −0.03 | −1.09 | −0.74 | −0.80 | −1.34 | −0.80 | −1.11 | −1.24 | −0.03 | −0.78 | 1 | HGG1 |
| 3230318 | −0.88 | −1.48 to −0.56 | −0.67 | −0.56 | −0.91 | −0.63 | −1.00 | −1.48 | −0.90 | −0.57 | −1.19 | 1 | HGG1 |
| 2663164 | −0.86 | −1.52 to −0.59 | −0.68 | −0.62 | −0.79 | −0.86 | −0.70 | −1.52 | −0.86 | −0.59 | −1.15 | 1 | HGG1 |
| 3200811 | −0.77 | −1.33 to 0.00 | 0.00 | −0.65 | −0.93 | −0.75 | −1.08 | −1.31 | −1.33 | −0.83 | 0.00 | 1 | HGG1 |
| 1697719 | −0.86 | −1.43 to 0.00 | −1.04 | −0.55 | −1.01 | −1.01 | −0.95 | −1.43 | −1.43 | −0.32 | 0.00 | 1 | HGG1 |
| 5208013 | −0.99 | −1.65 to −0.58 | −0.81 | −0.58 | −0.98 | −0.89 | −1.02 | −1.65 | −1.31 | −0.68 | −1.03 | 1 | HGG1 |
| 4590473 | −0.96 | −1.43 to −0.57 | −1.14 | −0.57 | −0.75 | −1.09 | −0.84 | −1.23 | −1.43 | −0.70 | −0.86 | 1 | HGG1 |
| 2890141 | −0.95 | −1.60 to −0.33 | −0.98 | −0.73 | −1.04 | −0.94 | −0.78 | −1.60 | −0.92 | −0.33 | −1.19 | 1 | HGG1 |
| 508943 | −0.93 | −1.37 to −0.59 | −0.84 | −1.02 | −0.93 | −1.37 | −0.70 | −1.17 | −0.91 | −0.79 | −0.59 | 1 | HGG1 |
| 4535971 | −1.00 | −1.72 to −0.64 | −0.81 | −0.64 | −0.86 | −0.65 | −1.05 | −1.72 | −1.18 | −0.83 | −1.23 | 1 | HGG1 |
| 5004556 | −0.93 | −1.38 to −0.68 | −0.68 | −0.73 | −0.86 | −0.84 | −0.98 | −1.38 | −1.14 | −0.74 | −1.01 | 1 | HGG1 |
| 3068429 | −0.86 | −1.57 to −0.39 | −0.39 | −0.64 | −0.94 | −0.80 | −0.71 | −1.57 | −1.03 | −0.87 | −0.76 | 1 | HGG1 |
| 2132606 | −1.00 | −1.32 to −0.73 | −0.82 | −0.98 | −1.10 | −1.32 | −1.02 | −1.32 | −0.93 | −0.73 | −0.76 | 1 | HGG1 |
| 4423361 | −0.90 | −1.40 to −0.67 | −0.77 | −0.78 | −0.88 | −0.67 | −0.95 | −1.40 | −0.92 | −0.78 | −0.96 | 1 | HGG1 |
| 4413637 | −0.91 | −1.38 to −0.47 | −0.67 | −0.84 | −0.47 | −0.67 | −1.14 | −1.38 | −1.36 | −1.01 | −0.68 | 1 | HGG1 |
| 4284270 | −0.96 | −1.52 to −0.57 | −0.85 | −0.68 | −0.94 | −0.94 | −0.98 | −1.52 | −1.23 | −0.57 | −0.91 | 1 | HGG1 |
| 2176212 | −0.74 | −1.33 to 0.00 | −0.28 | −0.82 | −0.84 | −0.86 | −0.85 | −1.33 | −1.10 | −0.57 | 0.00 | 1 | HGG1 |
| 2293496 | −0.89 | −1.41 to −0.49 | −0.86 | −0.70 | −0.95 | −0.75 | −0.83 | −1.41 | −0.83 | −0.49 | −1.19 | 1 | HGG1 |
| 4253663 | −0.96 | −1.37 to −0.63 | −0.80 | −0.63 | −0.92 | −0.79 | −1.06 | −1.37 | −1.36 | −0.86 | −0.82 | 1 | HGG1 |
| 3045790 | −0.77 | −1.33 to −0.33 | −0.76 | −0.33 | −0.62 | −0.62 | −0.70 | −1.26 | −1.33 | −0.51 | −0.77 | 1 | HGG1 |
| 3875135 | −0.82 | −1.35 to −0.46 | −0.65 | −0.46 | −0.66 | −0.56 | −0.74 | −1.35 | −1.07 | −0.73 | −1.16 | 1 | HGG1 |
| 1004382 | 1.32 | 1.10 to 1.57 | 1.35 | 1.10 | 1.39 | 1.52 | 1.32 | 1.57 | 1.36 | 1.18 | 1.13 | 2 | HGG1 |
| 1241484 | 1.34 | 1.01 to 1.76 | 1.26 | 1.01 | 1.34 | 1.52 | 1.33 | 1.76 | 1.53 | 1.25 | 1.04 | 2 | HGG1 |
| 2511277 | 1.43 | 1.04 to 1.60 | 1.57 | 1.04 | 1.14 | 1.57 | 1.47 | 1.51 | 1.47 | 1.49 | 1.60 | 2 | HGG1 |
| 2697275 | 1.36 | 1.04 to 1.63 | 1.45 | 1.04 | 1.42 | 1.51 | 1.31 | 1.63 | 1.39 | 1.23 | 1.28 | 2 | HGG1 |
| 2756333 | 1.45 | 1.07 to 1.98 | 1.42 | 1.07 | 1.49 | 1.43 | 1.44 | 1.98 | 1.68 | 1.22 | 1.32 | 2 | HGG1 |
| 1342744 | 1.56 | 1.08 to 1.99 | 1.43 | 1.08 | 1.42 | 1.57 | 1.64 | 1.99 | 1.88 | 1.55 | 1.49 | 2 | HGG1 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 2778441 | 1.65 | 1.19 to 2.00 | 1.65 | 1.19 | 1.61 | 1.63 | 1.67 | 2.00 | 1.74 | 1.68 | 1.67 | 2 | HGG1 |
| 279898 | 1.43 | 0.46 to 2.72 | 0.71 | 1.39 | 1.71 | 0.46 | 1.55 | 2.04 | 0.88 | 1.41 | 2.72 | 2 | HGG1 |
| 2833342 | 1.37 | 1.10 to 1.62 | 1.29 | 1.10 | 1.34 | 1.34 | 1.38 | 1.62 | 1.55 | 1.34 | 1.39 | 2 | HGG1 |
| 1459743 | 1.63 | 1.15 to 2.18 | 1.54 | 1.15 | 1.46 | 1.63 | 1.62 | 2.18 | 2.03 | 1.53 | 1.50 | 2 | HGG1 |
| 305751 | 1.54 | 1.03 to 1.90 | 1.50 | 1.23 | 1.54 | 1.61 | 1.54 | 1.86 | 1.90 | 1.03 | 1.66 | 2 | HGG1 |
| 3595618 | 1.39 | 1.15 to 1.57 | 1.35 | 1.15 | 1.36 | 1.40 | 1.42 | 1.57 | 1.49 | 1.35 | 1.38 | 2 | HGG1 |
| 1521272 | 1.53 | 1.09 to 2.04 | 1.41 | 1.09 | 1.54 | 1.50 | 1.58 | 2.04 | 1.75 | 1.51 | 1.34 | 2 | HGG1 |
| 1560906 | 1.80 | 1.39 to 2.19 | 1.94 | 1.42 | 1.95 | 2.06 | 1.80 | 2.19 | 1.91 | 1.39 | 1.56 | 2 | HGG1 |
| 3687719 | 1.67 | 1.17 to 2.16 | 1.77 | 1.17 | 1.60 | 1.58 | 1.60 | 2.16 | 1.95 | 1.70 | 1.52 | 2 | HGG1 |
| 3821432 | 1.51 | 1.07 to 1.93 | 1.39 | 1.07 | 1.39 | 1.39 | 1.56 | 1.93 | 1.89 | 1.50 | 1.43 | 2 | HGG1 |
| 4092112 | 1.60 | 1.24 to 2.02 | 1.61 | 1.24 | 1.44 | 1.45 | 1.74 | 2.02 | 1.75 | 1.52 | 1.61 | 2 | HGG1 |
| 5046235 | 1.55 | 1.04 to 2.05 | 1.60 | 1.04 | 1.15 | 1.46 | 1.56 | 2.05 | 2.05 | 1.29 | 1.78 | 2 | HGG1 |
| 5397446 | 1.36 | 1.02 to 1.57 | 1.34 | 1.02 | 1.48 | 1.28 | 1.33 | 1.55 | 1.49 | 1.57 | 1.22 | 2 | HGG1 |
| 671717 | 1.51 | 1.15 to 2.02 | 1.38 | 1.15 | 1.60 | 1.66 | 1.49 | 2.02 | 1.70 | 1.33 | 1.24 | 2 | HGG1 |
| 1956982 | 1.62 | 1.14 to 1.78 | 1.74 | 1.63 | 1.71 | 1.70 | 1.55 | 1.78 | 1.71 | 1.58 | 1.14 | 2 | HGG1 |
| 2046717 | 1.52 | 1.25 to 1.70 | 1.56 | 1.31 | 1.70 | 1.25 | 1.54 | 1.63 | 1.67 | 1.61 | 1.39 | 2 | HGG1 |
| 2070126 | 1.58 | 1.19 to 1.86 | 1.64 | 1.33 | 1.60 | 1.74 | 1.68 | 1.86 | 1.73 | 1.49 | 1.19 | 2 | HGG1 |
| 2120743 | 1.47 | 1.06 to 1.82 | 1.37 | 1.06 | 1.54 | 1.71 | 1.73 | 1.82 | 1.64 | 1.23 | 1.17 | 2 | HGG1 |
| 2313349 | 1.59 | 1.12 to 1.89 | 1.51 | 1.12 | 1.60 | 1.65 | 1.59 | 1.89 | 1.70 | 1.56 | 1.68 | 2 | HGG1 |
| 2403438 | 1.34 | 0.86 to 1.75 | 1.57 | 1.07 | 1.64 | 1.75 | 1.15 | 1.59 | 1.48 | 0.98 | 0.86 | 2 | HGG1 |
| 2445967 | 1.61 | 1.36 to 1.90 | 1.61 | 1.39 | 1.69 | 1.81 | 1.61 | 1.90 | 1.76 | 1.41 | 1.36 | 2 | HGG1 |
| 2494284 | 1.69 | 1.08 to 2.11 | 1.95 | 1.08 | 1.45 | 1.56 | 1.95 | 2.11 | 1.96 | 1.67 | 1.48 | 2 | HGG1 |
| 2506425 | 1.38 | 0.99 to 1.72 | 1.42 | 0.99 | 1.54 | 1.10 | 1.48 | 1.61 | 1.72 | 1.34 | 1.27 | 2 | HGG1 |
| 1910401 | −1.42 | −1.80 to −1.18 | −1.20 | −1.31 | −1.47 | −1.18 | −1.61 | −1.80 | −1.45 | −1.46 | −1.35 | 3 | HGG1 |
| 5047895 | −1.71 | −2.37 to −1.27 | −1.33 | −1.71 | −1.60 | −1.52 | −1.95 | −2.37 | −1.69 | −1.92 | −1.27 | 3 | HGG1 |
| 2042056 | −1.56 | −1.84 to −1.26 | −1.54 | −1.43 | −1.55 | −1.27 | −1.80 | −1.55 | −1.76 | −1.84 | −1.26 | 3 | HGG1 |
| 2047730 | −1.56 | −2.22 to −1.00 | −1.45 | −1.00 | −1.50 | −1.48 | −1.52 | −2.22 | −2.00 | −1.17 | −1.67 | 3 | HGG1 |
| 1441245 | −1.48 | −2.14 to −1.13 | −1.38 | −1.16 | −1.29 | −1.13 | −1.47 | −1.91 | −2.14 | −1.61 | −1.21 | 3 | HGG1 |
| 3975209 | −1.63 | −2.19 to −1.24 | −1.83 | −1.29 | −1.58 | −1.88 | −1.42 | −1.91 | −2.19 | −1.24 | −1.36 | 3 | HGG1 |
| 3679667 | −1.53 | −1.83 to −1.26 | −1.26 | −1.37 | −1.56 | −1.27 | −1.70 | −1.83 | −1.75 | −1.59 | −1.51 | 3 | HGG1 |
| 4698018 | −1.37 | −1.83 to −0.98 | −1.21 | −0.98 | −1.36 | −1.15 | −1.45 | −1.66 | −1.83 | −1.29 | −1.43 | 3 | HGG1 |
| 1868536 | −1.66 | −2.06 to −1.40 | −1.46 | −1.59 | −1.82 | −1.40 | −1.61 | −2.06 | −1.77 | −1.44 | −1.77 | 3 | HGG1 |
| 1876456 | −1.51 | −1.93 to −1.09 | −1.44 | −1.23 | −1.49 | −1.48 | −1.60 | −1.89 | −1.93 | −1.09 | −1.44 | 3 | HGG1 |
| 1619292 | −1.52 | −1.70 to −1.31 | −1.35 | −1.38 | −1.60 | −1.31 | −1.67 | −1.70 | −1.63 | −1.67 | −1.37 | 3 | HGG1 |
| 891072 | −1.52 | −2.15 to −1.08 | −1.29 | −1.24 | −1.51 | −1.50 | −1.55 | −2.15 | −1.75 | −1.08 | −1.56 | 3 | HGG1 |
| 2623304 | −1.46 | −1.79 to −1.14 | −1.14 | −1.40 | −1.32 | −1.21 | −1.52 | −1.79 | −1.65 | −1.57 | −1.56 | 3 | HGG1 |
| 1890576 | −1.54 | −1.98 to −0.92 | −1.26 | −1.94 | −1.76 | −1.43 | −1.98 | −1.65 | −1.39 | −1.51 | −0.92 | 3 | HGG1 |
| 2061528 | −1.63 | −2.10 to −1.41 | −1.57 | −1.43 | −1.53 | −1.41 | −1.73 | −2.02 | −2.10 | −1.41 | −1.46 | 3 | HGG1 |
| 3408804 | −1.49 | −2.16 to −0.93 | −1.19 | −1.27 | −1.39 | −0.93 | −1.59 | −1.66 | −1.70 | −2.16 | −1.54 | 3 | HGG1 |
| 2132607 | −1.53 | −2.12 to −1.10 | −1.20 | −1.10 | −1.46 | −1.37 | −1.71 | −2.12 | −2.12 | −1.26 | −1.40 | 3 | HGG1 |
| 5291518 | −1.45 | −1.72 to −1.10 | −1.20 | −1.20 | −1.35 | −1.10 | −1.62 | −1.70 | −1.68 | −1.72 | −1.47 | 3 | HGG1 |
| 1740474 | −1.56 | −1.82 to −1.36 | −1.57 | −1.36 | −1.63 | −1.46 | −1.80 | −1.82 | −1.60 | −1.36 | −1.44 | 3 | HGG1 |
| 3001212 | −1.67 | −2.20 to −1.14 | −1.69 | −1.31 | −1.55 | −1.90 | −1.58 | −2.20 | −2.08 | −1.14 | −1.55 | 3 | HGG1 |
| 2880819 | −1.08 | −1.62 to −0.57 | −1.11 | −0.57 | −1.16 | −0.98 | −1.09 | −1.55 | −1.62 | −0.67 | −1.00 | 4 | HGG1 |
| 2507552 | −1.06 | −1.45 to −0.69 | −0.94 | −0.95 | −1.06 | −1.02 | −1.15 | −1.45 | −1.40 | −0.69 | −0.94 | 4 | HGG1 |
| 3681722 | −1.11 | −1.39 to −0.56 | −1.04 | −1.28 | −1.27 | −1.35 | −1.39 | −1.39 | −0.98 | −0.56 | −0.74 | 4 | HGG1 |
| 96752 | −1.08 | −1.44 to −0.44 | −1.23 | −0.66 | −1.14 | −1.33 | −0.93 | −1.27 | −1.44 | −0.44 | −1.30 | 4 | HGG1 |
| 963331 | −1.03 | −1.32 to −0.59 | −0.94 | −1.00 | −1.07 | −1.20 | −1.14 | −1.32 | −1.11 | −0.59 | −0.88 | 4 | HGG1 |
| 1652328 | −1.19 | −1.86 to −0.69 | −1.12 | −0.78 | −1.07 | −1.30 | −1.02 | −1.86 | −1.42 | −0.69 | −1.41 | 4 | HGG1 |
| 3686603 | −1.10 | −1.67 to −0.53 | −1.14 | −0.72 | −0.90 | −1.19 | −1.12 | −1.67 | −1.53 | −0.53 | −1.08 | 4 | HGG1 |
| 2055814 | −1.19 | −1.57 to −0.80 | −1.26 | −1.15 | −1.18 | −1.26 | −1.30 | −1.57 | −0.93 | −0.80 | −1.31 | 4 | HGG1 |
| 2947188 | −1.09 | −1.55 to −0.66 | −1.18 | −0.78 | −0.96 | −1.18 | −1.11 | −1.35 | −1.55 | −0.66 | −1.05 | 4 | HGG1 |
| 2780013 | −1.09 | −1.46 to −0.88 | −0.89 | −0.88 | −1.13 | −1.07 | −1.11 | −1.41 | −1.46 | −0.89 | −0.94 | 4 | HGG1 |
| 1833362 | −1.31 | −1.98 to −0.86 | −1.21 | −0.86 | −1.17 | −1.22 | −1.30 | −1.98 | −1.82 | −0.94 | −1.30 | 4 | HGG1 |
| 4884214 | −1.09 | −1.57 to −0.53 | −1.21 | −1.05 | −1.02 | −1.32 | −0.96 | −1.31 | −1.57 | −0.53 | −1.34 | 4 | HGG1 |
| 3721985 | −1.05 | −1.59 to −0.47 | −0.88 | −0.94 | −1.00 | −1.12 | −1.04 | −1.59 | −1.32 | −0.47 | −1.12 | 4 | HGG1 |
| 41479 | −1.28 | −1.75 to −0.93 | −1.37 | −1.07 | −1.15 | −1.61 | −1.17 | −1.75 | −1.29 | −0.93 | −1.20 | 4 | HGG1 |
| 1840426 | −1.28 | −1.73 to −0.33 | −1.43 | −1.21 | −1.46 | −1.34 | −1.44 | −1.73 | −1.19 | −0.33 | −1.38 | 4 | HGG1 |
| 3126622 | −1.15 | −1.57 to −0.64 | −1.20 | −1.13 | −1.00 | −1.40 | −1.08 | −1.57 | −1.35 | −0.64 | −0.99 | 4 | HGG1 |
| 2078880 | −1.14 | −1.57 to −0.67 | −1.25 | −1.09 | −1.33 | −1.04 | −1.26 | −1.57 | −0.97 | −0.67 | −1.10 | 4 | HGG1 |
| 2372040 | −1.21 | −1.67 to −0.94 | −1.12 | −0.94 | −1.12 | −0.94 | −1.29 | −1.58 | −1.67 | −1.22 | −0.98 | 4 | HGG1 |
| 3890145 | −1.09 | −1.53 to −0.81 | −1.08 | −0.90 | −1.00 | −0.81 | −0.96 | −1.10 | −1.21 | −1.53 | −1.22 | 5 | HGG1 |
| 2055867 | −1.01 | −1.66 to −0.17 | −0.38 | −1.38 | −2.23 | −0.35 | −1.66 | −1.66 | −0.17 | −0.85 | −1.37 | 5 | HGG1 |
| 4886605 | −1.13 | −1.39 to −0.84 | −0.84 | −1.06 | −1.19 | −0.92 | −1.37 | −1.39 | −1.19 | −1.16 | −1.08 | 5 | HGG1 |
| 5045593 | −1.03 | −1.43 to −0.65 | −0.69 | −1.02 | −1.13 | −0.65 | −1.24 | −1.43 | −0.73 | −1.33 | −1.08 | 5 | HGG1 |
| 1807155 | −1.13 | −1.72 to −0.70 | −0.87 | −0.98 | −1.10 | −0.70 | −1.36 | −1.72 | −0.95 | −1.04 | −1.49 | 5 | HGG1 |
| 1501410 | −1.03 | −1.35 to −0.71 | −0.75 | −0.98 | −1.09 | −0.71 | −1.17 | −1.35 | −0.92 | −1.17 | −1.17 | 5 | HGO1 |
| 1700287 | −1.11 | −1.37 to −0.74 | −1.08 | −1.10 | −1.10 | −0.82 | −1.23 | −1.37 | −1.05 | −1.36 | −1.21 | 5 | HGG1 |
| 167081 | −1.00 | −1.61 to −0.53 | −0.98 | −1.61 | −1.08 | −1.04 | −1.42 | −0.81 | −0.53 | −0.84 | −0.72 | 5 | HGG1 |
| 2930673 | −1.09 | −1.76 to −0.65 | −0.65 | −0.92 | −0.95 | −0.92 | −1.08 | −1.76 | −1.35 | −1.20 | −0.99 | 5 | HGG1 |
| 2769888 | −1.22 | −1.62 to −0.56 | −0.78 | −1.28 | −1.48 | −0.69 | −1.41 | −1.62 | −0.56 | −1.61 | −1.59 | 5 | HGG1 |
| 2839946 | −1.19 | −1.68 to −0.85 | −0.85 | −1.09 | −1.36 | −1.22 | −1.44 | −1.68 | −0.89 | −1.36 | −0.86 | 5 | HGG1 |
| 3141607 | −1.00 | −1.46 to −0.74 | −0.85 | −1.00 | −1.13 | −0.74 | −1.10 | −1.46 | −0.87 | −0.89 | −0.96 | 5 | HGG1 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 3334476 | −0.99 | −1.39 to −0.77 | −0.95 | −0.90 | −0.94 | −0.80 | −1.09 | −1.39 | −0.77 | −0.85 | −1.22 | 5 | HGG1 |
| 3397390 | −1.20 | −1.62 to −0.66 | −0.97 | −1.32 | −1.29 | −0.98 | −1.50 | −1.62 | −0.66 | −1.13 | −1.34 | 5 | HGG1 |
| 3451645 | −1.21 | −1.76 to −0.93 | −1.02 | −0.93 | −1.21 | −1.06 | −1.28 | −1.76 | −1.07 | −1.05 | −1.54 | 5 | HGG1 |
| 2619954 | −1.05 | −1.57 to −0.70 | −0.74 | −0.70 | −0.95 | −0.70 | −1.16 | −1.57 | −1.35 | −1.21 | −1.05 | 5 | HGG1 |
| 2495131 | −1.13 | −1.60 to −0.55 | −1.09 | −1.60 | −1.40 | −1.09 | −1.16 | −0.81 | −0.83 | −0.55 | 5 | HGG1 |
| 2520894 | 2.40 | 1.78 to 2.94 | 2.40 | 1.78 | 2.31 | 2.26 | 2.46 | 2.92 | 2.94 | 2.34 | 2.21 | 6 | HGG1 |
| 3391835 | 2.10 | 1.58 to 2.78 | 2.16 | 1.58 | 1.82 | 1.72 | 2.49 | 2.40 | 2.78 | 1.67 | 2.27 | 6 | HGG1 |
| 1320685 | 2.02 | 1.59 to 2.47 | 1.94 | 1.59 | 1.86 | 1.98 | 2.12 | 2.47 | 2.20 | 1.99 | 2.01 | 6 | HGG1 |
| 2823767 | 2.15 | 1.74 to 2.50 | 2.14 | 1.74 | 2.12 | 2.16 | 2.18 | 2.50 | 2.48 | 2.05 | 2.02 | 6 | HGG1 |
| 1457424 | 2.53 | 2.15 to 2.94 | 2.31 | 2.15 | 2.63 | 2.66 | 2.73 | 2.94 | 2.62 | 2.41 | 2.34 | 6 | HGG1 |
| 5509134 | 2.02 | 1.81 to 2.28 | 2.08 | 1.81 | 2.28 | 2.18 | 2.08 | 1.97 | 1.96 | 1.93 | 1.88 | 6 | HGG1 |
| 548114 | 1.91 | 1.53 to 2.16 | 2.12 | 1.53 | 1.72 | 1.74 | 1.96 | 2.06 | 2.16 | 2.14 | 1.72 | 6 | HGG1 |
| 3792988 | 2.25 | 1.73 to 2.86 | 2.17 | 1.73 | 2.18 | 2.32 | 2.29 | 2.86 | 2.62 | 2.03 | 2.04 | 6 | HGG1 |
| 459372 | 2.07 | 1.69 to 2.25 | 2.06 | 1.83 | 2.21 | 2.19 | 2.24 | 2.20 | 2.25 | 1.69 | 1.94 | 6 | HGG1 |
| 2110430 | 2.38 | 1.96 to 3.02 | 2.22 | 1.96 | 2.31 | 2.40 | 2.42 | 3.02 | 2.63 | 2.25 | 2.18 | 6 | HGG1 |
| 2956444 | 2.04 | 1.62 to 2.46 | 1.88 | 1.62 | 1.99 | 2.04 | 2.07 | 2.46 | 2.26 | 2.13 | 1.89 | 6 | HGG1 |
| 1684617 | 1.88 | 1.39 to 2.38 | 1.87 | 1.39 | 1.92 | 2.01 | 2.00 | 2.38 | 2.14 | 1.59 | 1.65 | 6 | HGG1 |
| 3068809 | 2.01 | 1.69 to 2.27 | 2.07 | 1.69 | 2.04 | 2.12 | 2.00 | 2.27 | 2.14 | 1.89 | 1.88 | 6 | HGG1 |
| 4287327 | 2.29 | 1.91 to 2.83 | 1.91 | 1.93 | 2.07 | 1.98 | 2.30 | 2.75 | 2.30 | 2.83 | 2.56 | 6 | HGG1 |
| 2516950 | 1.86 | 1.60 to 2.19 | 1.81 | 1.60 | 1.96 | 2.00 | 1.90 | 2.19 | 1.96 | 1.67 | 1.70 | 6 | HGG1 |
| 3606046 | 1.85 | 1.37 to 2.42 | 1.65 | 1.37 | 1.82 | 1.86 | 1.95 | 2.42 | 2.27 | 1.66 | 1.63 | 6 | HGG1 |
| 617587 | 2.41 | 1.72 to 2.96 | 2.44 | 1.72 | 2.21 | 2.19 | 2.50 | 2.96 | 2.88 | 2.51 | 2.31 | 6 | HGG1 |
| 1299246 | 0.75 | −0.03 to 1.47 | 0.29 | 0.59 | 0.95 | −0.03 | 0.97 | 1.22 | 0.47 | 0.84 | 1.47 | 7 | HGG1 |
| 1308729 | 0.81 | 0.04 to 1.58 | 0.33 | 0.66 | 0.94 | 0.04 | 0.95 | 1.28 | 0.60 | 0.92 | 1.58 | 7 | HGG1 |
| 2959255 | 0.21 | −0.25 to 1.33 | 0.04 | 0.08 | 0.02 | −0.25 | 0.25 | −0.11 | 0.28 | 1.33 | 0.29 | 7 | HGG1 |
| 1513566 | 0.77 | 0.19 to 1.35 | 0.43 | 0.59 | 0.82 | 0.19 | 0.98 | 1.18 | 0.53 | 0.84 | 1.35 | 7 | HGG1 |
| 2358261 | 0.49 | 0.00 to 1.63 | 0.00 | 1.27 | 1.63 | 0.00 | 0.00 | 0.00 | 0.90 | 0.64 | 0.00 | 7 | HGG1 |
| 2956869 | 0.91 | 0.50 to 1.50 | 0.97 | 0.80 | 0.82 | 0.61 | 0.98 | 0.50 | 1.00 | 1.50 | 1.02 | 7 | HGG1 |
| 4087621 | 1.01 | 0.29 to 1.78 | 1.18 | 1.03 | 0.89 | 0.63 | 1.20 | 0.29 | 0.89 | 1.78 | 1.15 | 7 | HGG1 |
| 898741 | 0.47 | 0.00 to 1.39 | 0.00 | 0.56 | 0.43 | 0.61 | 0.58 | 0.01 | 0.65 | 1.39 | 0.00 | 7 | HGG1 |
| 2051568 | 0.50 | −0.12 to 1.59 | 0.48 | 0.49 | 0.39 | −0.06 | 0.46 | −0.12 | 0.50 | 1.59 | 0.78 | 7 | HGG1 |
| 2675433 | 0.59 | 0.29 to 1.33 | 0.36 | 0.51 | 0.48 | 0.29 | 0.77 | 0.48 | 0.57 | 1.33 | 0.47 | 7 | HGG1 |
| 2742315 | 0.30 | 0.00 to 1.39 | 0.00 | 0.69 | 0.63 | 0.00 | 0.00 | 0.00 | 0.00 | 1.39 | 0.00 | 7 | HGG1 |
| 4858420 | 0.61 | −0.15 to 1.36 | 0.25 | 0.41 | 0.66 | −0.15 | 0.69 | 1.05 | 0.48 | 0.71 | 1.36 | 7 | HGG1 |
| 5038177 | 0.77 | 0.11 to 1.38 | 0.36 | 0.60 | 0.84 | 0.11 | 0.95 | 1.20 | 0.59 | 0.90 | 1.38 | 7 | HGG1 |
| 2908212 | 0.46 | 0.00 to 1.53 | 0.00 | 1.17 | 1.46 | 0.00 | 0.00 | 0.00 | 0.00 | 1.53 | 0.00 | 7 | HGG1 |
| 136073 | 1.04 | 0.00 to 1.66 | 0.90 | 0.81 | 0.92 | 1.08 | 1.35 | 1.66 | 1.50 | 1.11 | 0.00 | 8 | HGG1 |
| 1604437 | 1.18 | 0.00 to 2.00 | 1.52 | 0.78 | 1.16 | 1.18 | 1.40 | 1.65 | 2.00 | 0.96 | 0.00 | 8 | HGG1 |
| 1723834 | 0.72 | 0.00 to 1.65 | 0.00 | 0.82 | 1.57 | 0.00 | 0.00 | 1.65 | 1.32 | 1.12 | 0.00 | 8 | HGG1 |
| 2061171 | 1.17 | 0.00 to 1.76 | 1.27 | 0.96 | 1.32 | 1.36 | 1.34 | 1.76 | 1.39 | 1.12 | 0.00 | 8 | HGG1 |
| 301206 | 0.67 | 0.00 to 1.37 | 0.00 | 0.73 | 1.26 | 0.00 | 0.00 | 1.29 | 1.35 | 1.37 | 0.00 | 8 | HGG1 |
| 1857044 | 0.96 | 0.00 to 1.51 | 0.91 | 0.68 | 1.11 | 1.10 | 1.19 | 1.51 | 1.30 | 0.81 | 0.00 | 8 | HGG1 |
| 2695371 | 0.70 | 0.00 to 1.56 | 0.00 | 0.70 | 1.11 | 0.94 | 0.00 | 1.56 | 1.25 | 0.74 | 0.00 | 8 | HGG1 |
| 1824860 | 0.77 | 0.00 to 1.37 | 0.00 | 0.46 | 0.92 | 0.78 | 1.01 | 1.37 | 1.19 | 1.17 | 0.00 | 8 | HGG1 |
| 4630674 | 0.87 | 0.00 to 1.55 | 0.00 | 1.14 | 1.55 | 1.41 | 1.39 | 1.31 | 0.00 | 1.03 | 0.00 | 8 | HGG1 |
| 531505 | 1.07 | 0.00 to 1.37 | 1.21 | 1.00 | 1.23 | 1.37 | 1.17 | 1.33 | 1.11 | 1.24 | 0.00 | 8 | HGG1 |
| 4408943 | −1.93 | −2.56 to −1.57 | −1.72 | −1.57 | −1.79 | −1.60 | −2.01 | −2.56 | −2.30 | −1.99 | −1.80 | 9 | HGG1 |
| 2886955 | −2.01 | −2.50 to −1.60 | −2.11 | −1.60 | −2.15 | −1.66 | −2.17 | −2.26 | −2.50 | −1.83 | −1.85 | 9 | HGG1 |
| 2506973 | −1.86 | −2.28 to −1.43 | −1.84 | −1.43 | −1.91 | −1.73 | −1.89 | −2.28 | −2.07 | −1.65 | −1.89 | 9 | HGG1 |
| 3031022 | −1.97 | −2.37 to −1.78 | −1.82 | −1.80 | −2.19 | −1.85 | −2.07 | −2.37 | −1.78 | −1.79 | −2.11 | 9 | HGG1 |
| 2912637 | −2.30 | −2.54 to −2.00 | −2.37 | −2.23 | −2.30 | −2.47 | −2.28 | −2.44 | −2.08 | −2.00 | 9 | HGG1 |
| 1596220 | −1.95 | −2.49 to −1.40 | −1.91 | −1.40 | −1.82 | −1.75 | −1.92 | −2.47 | −2.49 | −1.94 | −1.89 | 9 | HGG1 |
| 5541828 | −2.26 | −3.04 to −1.53 | −2.15 | −1.53 | −2.05 | −1.96 | −2.23 | −3.04 | −2.98 | −2.05 | −2.38 | 9 | HGG1 |
| 560115 | −2.07 | −2.46 to −1.84 | −1.84 | −2.11 | −2.24 | −1.88 | −2.37 | −2.46 | −1.87 | −1.87 | −1.97 | 9 | HGG1 |
| 2818476 | 3.29 | 2.79 to 3.80 | 3.05 | 2.79 | 3.41 | 2.82 | 3.32 | 3.77 | 3.80 | 3.26 | 3.36 | 10 | HGG1 |
| 1630990 | 3.00 | 2.56 to 3.39 | 2.90 | 2.56 | 3.19 | 2.95 | 3.16 | 3.25 | 3.39 | 2.82 | 2.83 | 10 | HGG1 |
| 2755836 | 3.57 | 3.17 to 4.02 | 3.43 | 3.17 | 3.92 | 3.25 | 3.68 | 3.89 | 4.02 | 3.43 | 3.31 | 10 | HGG1 |
| 5501676 | 2.89 | 2.33 to 3.49 | 2.53 | 2.46 | 3.33 | 2.56 | 2.92 | 3.49 | 3.43 | 2.92 | 2.33 | 10 | HGG1 |
| 4549259 | 3.30 | 2.73 to 3.86 | 3.12 | 2.73 | 3.29 | 3.04 | 3.38 | 3.86 | 3.81 | 3.35 | 3.14 | 10 | HGG1 |
| | | 0.00 to 0.00 | | | | | | | | | | | HGG1 |
| 1740975 | −0.04 | −1.53 to 0.37 | −1.53 | 0.21 | 0.26 | 0.36 | 0.00 | 0.00 | 0.00 | 0.37 | 0.00 | 11 | HGG1 |
| 2313581 | −0.20 | −1.99 to 0.26 | −1.99 | −0.06 | 0.26 | 0.00 | 0.00 | 0.00 | 0.00 | 0.00 | 0.00 | 11 | HGG1 |
| 1209413 | −0.15 | −1.60 to 0.60 | 0.00 | 0.38 | −1.60 | 0.00 | 0.00 | 0.00 | 0.00 | 0.60 | 0.00 | 0 | HGG2 |
| 641039 | 0.29 | 0.00 to 1.69 | 0.00 | 1.69 | 0.00 | 0.00 | 0.00 | 0.00 | 0.00 | 0.97 | 0.00 | 0 | HGG2 |
| 686993 | 0.36 | 0.00 to 1.42 | 0.00 | 0.81 | 0.00 | 0.00 | 0.00 | 1.42 | 0.00 | 1.02 | 0.00 | 0 | HGG2 |
| 2246915 | 0.29 | 0.00 to 1.35 | 0.00 | 1.22 | 0.00 | 0.00 | 0.00 | 0.00 | 0.00 | 1.35 | 0.00 | 0 | HGG2 |
| 916103 | 0.26 | 0.00 to 1.59 | 0.00 | 0.36 | 0.00 | 0.00 | 0.00 | 0.00 | 0.00 | 1.59 | 0.43 | 0 | HGG2 |
| 1998317 | −0.15 | −1.44 to 0.50 | 0.00 | −0.43 | −1.44 | 0.00 | 0.00 | 0.00 | 0.00 | 0.50 | 0.00 | 0 | HGG2 |
| 2260285 | −0.18 | −1.54 to 0.35 | 0.00 | −0.44 | −1.54 | 0.00 | 0.00 | 0.00 | 0.00 | 0.35 | 0.00 | 0 | HGG2 |
| 2291665 | −0.17 | −1.38 to 0.20 | 0.00 | −0.34 | −1.38 | 0.00 | 0.00 | 0.00 | 0.00 | 0.20 | 0.00 | 0 | HGG2 |
| 2302785 | −0.19 | −1.43 to 0.27 | 0.00 | −0.56 | −1.43 | 0.00 | 0.00 | 0.00 | 0.00 | 0.27 | 0.00 | 0 | HGG2 |
| 2302810 | 0.34 | −0.05 to 2.62 | 0.00 | −0.05 | 0.00 | 0.00 | 0.00 | 0.00 | 0.00 | 0.48 | 2.62 | 0 | HGG2 |
| 1741288 | 0.12 | −0.44 to 1.72 | 0.00 | −0.41 | −0.44 | 0.04 | 0.03 | −0.04 | 1.72 | 0.02 | 0.19 | 0 | HGG2 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 2383242 | −0.15 | −1.58 to 0.43 | 0.00 | −0.23 | −1.58 | 0.00 | 0.00 | 0.00 | 0.00 | 0.43 | 0.00 | 0 | HGG2 |
| 1909281 | 0.18 | −0.31 to 1.55 | 0.00 | −0.31 | 0.00 | 0.00 | 0.00 | 0.00 | 1.55 | 0.40 | 0.00 | 0 | HGG2 |
| 2395112 | 0.20 | −0.05 to 1.82 | 0.00 | −0.05 | 0.00 | 0.00 | 1.82 | 0.00 | 0.00 | 0.02 | 0.00 | 0 | HGG2 |
| 2761527 | 0.35 | 0.00 to 2.16 | 0.00 | 0.31 | 0.00 | 0.00 | 0.00 | 0.00 | 2.16 | 0.67 | 0.00 | 0 | HGG2 |
| 1930088 | −0.16 | −1.47 to 0.11 | 0.00 | −0.06 | −1.47 | 0.00 | 0.00 | 0.00 | 0.00 | 0.11 | 0.00 | 0 | HGG2 |
| 3035780 | −0.30 | −3.26 to 0.43 | 0.00 | 0.43 | −3.26 | 0.00 | 0.00 | 0.00 | 0.00 | 0.17 | 0.00 | 0 | HGG2 |
| 2409976 | 1.19 | 0.82 to 1.41 | 1.30 | 0.82 | 1.28 | 1.39 | 1.07 | 1.41 | 0.99 | 1.22 | 1.20 | 1 | HGG2 |
| 2838627 | 1.08 | 0.71 to 1.35 | 1.01 | 0.71 | 1.12 | 1.30 | 1.35 | 1.25 | 0.86 | 0.98 | 1.09 | 1 | HGG2 |
| 3047143 | 1.08 | 0.57 to 1.35 | 1.13 | 0.57 | 1.12 | 1.26 | 1.13 | 1.24 | 1.35 | 0.90 | 1.06 | 1 | HGG2 |
| 2725369 | 1.20 | 0.83 to 1.63 | 1.52 | 0.83 | 1.08 | 1.41 | 1.42 | 1.63 | 0.99 | 1.08 | 0.85 | 1 | HGG2 |
| 2173973 | 1.04 | 0.70 to 1.38 | 0.97 | 0.70 | 1.09 | 1.17 | 0.95 | 1.20 | 0.94 | 0.92 | 1.38 | 1 | HGG2 |
| 2499418 | 0.84 | 0.39 to 1.37 | 0.77 | 0.39 | 0.85 | 1.00 | 0.72 | 0.97 | 1.37 | 0.61 | 0.91 | 1 | HGG2 |
| 755223 | 1.21 | 0.86 to 1.63 | 1.20 | 0.86 | 1.14 | 1.23 | 1.14 | 1.41 | 1.63 | 1.18 | 1.09 | 1 | HGG2 |
| 757514 | 1.03 | 0.54 to 2.33 | 0.90 | 0.54 | 0.83 | 1.01 | 0.85 | 1.21 | 2.33 | 0.78 | 0.88 | 1 | HGG2 |
| 859218 | 0.96 | 0.40 to 1.61 | 0.90 | 0.40 | 0.88 | 1.06 | 1.11 | 1.15 | 1.61 | 0.70 | 0.86 | 1 | HGG2 |
| 870396 | 1.12 | 0.95 to 1.34 | 1.13 | 0.95 | 1.20 | 1.29 | 1.09 | 1.13 | 0.98 | 0.98 | 1.34 | 1 | HGG2 |
| 2499905 | 1.11 | 0.50 to 1.45 | 1.28 | 0.95 | 1.14 | 1.14 | 1.21 | 1.16 | 0.50 | 1.11 | 1.45 | 1 | HGG2 |
| 2021989 | 1.31 | 0.94 to 1.58 | 1.42 | 0.94 | 1.20 | 1.25 | 1.28 | 1.45 | 1.58 | 1.43 | 1.25 | 1 | HGG2 |
| 2025128 | 0.93 | 0.30 to 1.39 | 0.98 | 0.30 | 0.83 | 1.05 | 1.02 | 1.11 | 1.39 | 0.72 | 1.00 | 1 | HGG2 |
| 1926934 | 1.28 | 0.00 to 2.42 | 0.00 | 1.58 | 1.95 | 0.00 | 1.85 | 2.06 | 0.00 | 1.66 | 2.42 | 2 | HGG2 |
| 2394990 | 1.18 | 0.00 to 1.49 | 1.35 | 0.98 | 1.37 | 1.28 | 1.36 | 1.35 | 0.00 | 1.44 | 1.49 | 2 | HGG2 |
| 1487428 | 1.02 | 0.00 to 1.49 | 0.00 | 1.04 | 1.38 | 1.37 | 1.09 | 1.33 | 0.00 | 1.49 | 1.45 | 2 | HGG2 |
| 1515346 | 1.15 | 0.00 to 1.53 | 1.29 | 0.90 | 1.22 | 1.46 | 1.38 | 1.43 | 0.00 | 1.15 | 1.53 | 2 | HGG2 |
| 1670407 | 0.93 | 0.00 to 1.39 | 0.00 | 0.90 | 1.39 | 1.35 | 1.13 | 1.25 | 0.00 | 1.13 | 1.23 | 2 | HGG2 |
| 1986919 | 0.84 | 0.00 to 1.55 | 0.00 | 0.96 | 0.98 | 0.94 | 1.15 | 1.03 | 0.00 | 1.55 | 0.98 | 2 | HGG2 |
| 2018315 | 1.41 | 0.00 to 1.80 | 1.60 | 1.06 | 1.49 | 1.80 | 1.70 | 1.80 | 0.00 | 1.49 | 1.76 | 2 | HGG2 |
| 2226309 | 0.85 | 0.00 to 2.32 | 0.00 | 1.59 | 2.03 | 0.00 | 0.00 | 0.00 | 0.00 | 1.74 | 2.32 | 2 | HGG2 |
| 2057513 | 0.92 | 0.00 to 1.39 | 0.75 | 0.66 | 1.15 | 1.17 | 1.19 | 1.39 | 0.00 | 1.02 | 0.98 | 2 | HGG2 |
| 869702 | 0.88 | 0.00 to 1.48 | 0.00 | 0.67 | 1.10 | 1.27 | 1.18 | 1.16 | 0.00 | 1.06 | 1.48 | 2 | HGG2 |
| 3426776 | 0.81 | 0.00 to 1.39 | 0.00 | 0.53 | 0.95 | 1.23 | 1.29 | 1.39 | 0.00 | 0.88 | 1.05 | 2 | HGG2 |
| 619447 | 0.81 | 0.00 to 1.35 | 0.00 | 0.59 | 0.92 | 1.21 | 1.13 | 1.35 | 0.00 | 1.01 | 1.06 | 2 | HGG2 |
| 2253868 | −0.99 | −1.38 to −0.58 | −1.13 | −0.92 | −0.86 | −1.16 | −1.00 | −1.17 | −1.38 | −0.58 | −0.66 | 3 | HGG2 |
| 24698991 | −0.92 | −1.34 to −0.52 | −0.90 | −1.02 | −1.34 | −1.20 | −1.06 | −1.01 | −0.65 | −0.57 | −0.52 | 3 | HGG2 |
| 2453558 | −1.23 | −1.48 to −1.01 | −1.36 | −1.35 | −1.28 | −1.13 | −1.01 | −1.11 | −1.48 | −1.15 | −1.20 | 3 | HGG2 |
| 2794866 | −1.32 | −1.94 to −0.97 | −1.28 | −0.97 | −1.43 | −1.34 | −1.21 | −1.45 | −1.94 | −0.97 | −1.32 | 3 | HGG2 |
| 1401312 | −1.06 | −1.49 to −0.82 | −1.09 | −0.89 | −1.01 | −1.22 | −0.92 | −1.49 | −1.25 | −0.82 | −0.87 | 3 | HGG2 |
| 2188005 | −0.83 | −1.40 to −0.62 | −0.75 | −0.79 | −0.75 | −0.62 | −0.88 | −0.74 | −1.40 | −0.75 | −0.74 | 3 | HGG2 |
| 1753283 | −1.46 | −1.66 to −1.01 | −1.66 | −1.43 | −1.56 | −1.49 | −1.51 | −1.52 | −1.56 | −1.01 | −1.39 | 3 | HGG2 |
| 3115505 | −0.94 | −1.44 to −0.53 | −0.83 | −1.10 | −0.95 | −1.00 | −0.98 | −0.81 | −1.44 | −0.85 | −0.53 | 3 | HGG2 |
| 2703122 | −1.44 | −1.63 to −1.24 | −1.63 | −1.45 | −1.50 | −1.42 | −1.51 | −1.57 | −1.37 | −1.24 | −1.32 | 3 | HGG2 |
| 2230608 | 1.34 | 0.93 to 1.93 | 1.21 | 0.93 | 1.28 | 1.44 | 1.50 | 1.43 | 1.93 | 1.08 | 1.24 | 4 | HGG2 |
| 2837006 | 1.52 | 1.13 to 2.04 | 1.46 | 1.13 | 1.56 | 1.65 | 1.44 | 1.67 | 2.04 | 1.20 | 1.56 | 4 | HGG2 |
| 1407125 | 1.61 | 1.15 to 1.88 | 1.75 | 1.15 | 1.61 | 1.59 | 1.64 | 1.66 | 1.70 | 1.88 | 1.47 | 4 | HGG2 |
| 1709709 | 1.40 | 0.97 to 1.85 | 1.32 | 0.97 | 1.37 | 1.60 | 1.37 | 1.57 | 1.85 | 1.21 | 1.32 | 4 | HGG2 |
| 3206352 | 1.84 | 1.41 to 2.23 | 1.62 | 1.41 | 1.76 | 1.98 | 2.02 | 1.97 | 2.23 | 1.56 | 1.98 | 4 | HGG2 |
| 1911819 | 1.64 | 1.29 to 1.91 | 1.65 | 1.30 | 1.60 | 1.87 | 1.57 | 1.91 | 1.70 | 1.29 | 1.84 | 4 | HGG2 |
| 1988540 | 1.69 | 1.15 to 1.97 | 1.95 | 1.56 | 1.85 | 1.73 | 1.67 | 1.74 | 1.15 | 1.55 | 1.97 | 4 | HGG2 |
| 626471 | 1.65 | 0.00 to 2.29 | 0.00 | 1.43 | 1.81 | 1.95 | 1.74 | 1.97 | 2.29 | 1.57 | 2.10 | 4 | HGG2 |
| 960604 | 1.51 | 0.89 to 2.21 | 1.50 | 1.35 | 1.59 | 1.54 | 1.18 | 1.60 | 2.21 | 0.89 | 1.69 | 4 | HGG2 |
| 1326255 | 3.24 | 2.13 to 3.68 | 3.67 | 3.26 | 3.40 | 3.43 | 2.99 | 2.93 | 2.13 | 3.68 | 3.62 | 5 | HGG2 |
| 2234266 | 2.05 | 0.00 to 2.89 | 0.00 | 2.30 | 2.88 | 2.61 | 2.68 | 2.71 | 0.00 | 2.38 | 2.89 | 5 | HGG2 |
| 660142 | 2.87 | 2.38 to 3.21 | 2.96 | 2.38 | 2.88 | 2.97 | 2.70 | 3.00 | 3.21 | 2.54 | 3.17 | 5 | HGG2 |
| 1316801 | 2.15 | 0.00 to 2.73 | 0.00 | 2.04 | 2.38 | 2.57 | 2.28 | 2.55 | 2.73 | 2.15 | 2.65 | 5 | HGG2 |
| 1303862 | 2.14 | 0.00 to 3.23 | 0.00 | 2.52 | 2.80 | 0.00 | 2.72 | 2.34 | 3.23 | 3.07 | 2.57 | 5 | HGG2 |
| 2124056 | 2.68 | 2.41 to 3.04 | 3.04 | 2.41 | 2.58 | 2.76 | 2.63 | 2.85 | 2.78 | 2.58 | 2.50 | 5 | HGG2 |
| 2544622 | 3.17 | 2.78 to 3.70 | 3.04 | 2.78 | 3.36 | 3.05 | 3.14 | 3.09 | 3.70 | 3.11 | 3.23 | 5 | HGG2 |
| 1961617 | 2.01 | 0.00 to 2.69 | 0.00 | 1.92 | 2.29 | 2.15 | 2.23 | 2.29 | 2.58 | 1.94 | 2.69 | 5 | HGG2 |
| 3421730 | −0.87 | −1.34 to −0.26 | −0.50 | −1.34 | −1.16 | −0.61 | −0.09 | −0.88 | −0.26 | −1.22 | −0.97 | 6 | HGG2 |
| 1973123 | −0.93 | −1.37 to 0.00 | −1.06 | −1.04 | −0.99 | −1.17 | −1.02 | −1.37 | 0.00 | −0.75 | −0.93 | 6 | HGG2 |
| 1988774 | −1.09 | −1.87 to −0.08 | −0.52 | −1.87 | −1.68 | −0.80 | −1.46 | −1.28 | −0.08 | −0.93 | −1.16 | 6 | HGG2 |
| 3084204 | −1.53 | −1.69 to −1.23 | −1.50 | −1.66 | −1.69 | −1.49 | −1.64 | −1.65 | −1.61 | −1.35 | −1.23 | 0 | HGG3 |
| 3090808 | −1.13 | −1.53 to −0.65 | −1.07 | −0.84 | −1.19 | −1.37 | −0.96 | −1.53 | −1.38 | −0.65 | −1.15 | 0 | HGG3 |
| 3097624 | −1.24 | −1.52 to −0.89 | −1.01 | −1.52 | −1.40 | −1.16 | −1.51 | −1.31 | −1.21 | −1.10 | −0.89 | 0 | HGG3 |
| 5427710 | −2.13 | −2.26 to 1.89 | −2.13 | −2.26 | −2.22 | −2.23 | −1.96 | −2.13 | −2.23 | −2.12 | −1.89 | 0 | HGG3 |
| 1911443 | −1.04 | −1.46 to −0.43 | −0.59 | −1.41 | −1.46 | −0.50 | −1.05 | −1.33 | −0.43 | −1.31 | −1.27 | 0 | HGG3 |
| 3120209 | −1.51 | −2.04 to −0.98 | −2.04 | −1.51 | −1.30 | −1.93 | −1.38 | −1.12 | −1.91 | −1.42 | −0.98 | 0 | HGG3 |
| 5399371 | −0.97 | −1.74 to −0.43 | −0.71 | −1.74 | −1.02 | −0.97 | −1.38 | −0.87 | −0.43 | −0.97 | −0.68 | 0 | HGG3 |
| 5166479 | −1.47 | −2.20 to −0.81 | −0.98 | −2.20 | −1.84 | −1.24 | −1.87 | −1.64 | −0.81 | −1.59 | −1.08 | 0 | HGG3 |
| 2698777 | −0.99 | −1.37 to −0.61 | −0.81 | −1.13 | −1.37 | −1.32 | −1.02 | −1.13 | −0.72 | −0.61 | −0.77 | 0 | HGG3 |
| 3135460 | −1.37 | −1.83 to −0.86 | −0.86 | −1.67 | −1.69 | −0.90 | −1.37 | −1.83 | −0.95 | −1.44 | −1.60 | 0 | HGG3 |
| 4715924 | −1.06 | −1.46 to −0.40 | −1.33 | −0.88 | −1.03 | −1.46 | −0.98 | −1.37 | −1.16 | −0.40 | −0.91 | 0 | HGG3 |
| 5089438 | −1.34 | −1.63 to −0.87 | −1.52 | −1.63 | −1.63 | −1.32 | −1.36 | −1.29 | −1.33 | −1.12 | −0.87 | 0 | HGG3 |
| 3170010 | −0.46 | −1.47 to 0.05 | −0.30 | −1.47 | −0.91 | 0.00 | 0.00 | −0.68 | 0.05 | −0.87 | 0.00 | 0 | HGG3 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 3778404 | −1.91 | −2.25 to −1.58 | −1.86 | −2.09 | −2.25 | −2.06 | −1.93 | −1.97 | −1.80 | −1.58 | −1.62 | 0 | HGG3 |
| 4289557 | −1.92 | −2.27 to −1.57 | −1.95 | −2.07 | −2.27 | −1.84 | −1.97 | −1.97 | −2.01 | −1.57 | −1.60 | 0 | HGG3 |
| 5076842 | −0.62 | −1.69 to 0.00 | −1.33 | −1.28 | −1.31 | 0.00 | 0.00 | −1.69 | 0.00 | 0.00 | 0.00 | 0 | HGG3 |
| 4894508 | −0.99 | −1.60 to −0.60 | −0.96 | −1.60 | −1.11 | −0.88 | −1.12 | −0.94 | −0.69 | −0.98 | −0.60 | 0 | HGG3 |
| 5573549 | −1.44 | −1.65 to −1.22 | −1.35 | −1.46 | −1.65 | −1.60 | −1.41 | −1.65 | −1.34 | −1.27 | −1.22 | 0 | HGG3 |
| 654246 | −1.22 | −1.56 to −0.92 | −1.16 | −1.56 | −1.42 | −1.25 | −1.14 | −1.25 | −1.09 | −1.23 | −0.92 | 0 | HGG3 |
| 3633707 | 0.73 | 0.38 to 1.64 | 0.64 | 0.38 | 0.50 | 0.61 | 0.85 | 0.66 | 0.81 | 0.46 | 1.64 | 1 | HGG3 |
| 3960194 | 1.17 | 0.77 to 1.45 | 1.09 | 0.77 | 0.94 | 1.17 | 1.31 | 1.35 | 1.45 | 1.32 | 1.15 | 1 | HGG3 |
| 3974247 | 1.32 | 0.97 to 1.65 | 1.41 | 1.04 | 1.28 | 1.65 | 1.46 | 1.43 | 1.56 | 0.97 | 1.07 | 1 | HGG3 |
| 2871076 | 1.23 | 0.86 to 1.50 | 1.35 | 1.09 | 1.20 | 1.50 | 1.36 | 1.31 | 1.40 | 0.97 | 0.86 | 1 | HGG3 |
| 3034889 | 1.36 | 1.01 to 1.54 | 1.49 | 1.01 | 1.35 | 1.54 | 1.44 | 1.50 | 1.53 | 1.08 | 1.31 | 1 | HGG3 |
| 3057267 | 0.67 | −0.05 to 2.09 | 0.31 | −0.05 | 2.09 | 1.44 | 0.72 | 0.48 | 0.50 | 0.15 | 0.36 | 1 | HGG3 |
| 4252872 | 1.13 | 0.89 to 1.32 | 1.31 | 1.07 | 1.09 | 1.27 | 1.07 | 1.32 | 1.26 | 0.93 | 0.89 | 1 | HGG3 |
| 3495173 | 1.34 | 1.15 to 1.58 | 1.39 | 1.15 | 1.30 | 1.58 | 1.28 | 1.48 | 1.46 | 1.22 | 1.23 | 1 | HGG3 |
| 3957354 | 1.26 | 0.00 to 3.28 | 0.00 | 2.66 | 2.97 | 3.28 | 0.00 | 0.00 | 0.00 | 2.43 | 0.00 | 1 | HGG3 |
| 4340307 | 0.63 | 0.19 to 1.66 | 0.62 | 0.19 | 0.52 | 0.55 | 0.49 | 0.65 | 1.66 | 0.39 | 0.58 | 1 | HGG3 |
| 4508879 | 1.24 | 0.00 to 1.86 | 1.20 | 1.63 | 1.60 | 1.25 | 1.86 | 1.31 | 0.00 | 1.31 | 0.99 | 1 | HGG3 |
| 4863677 | 1.12 | 0.78 to 1.38 | 1.17 | 0.78 | 1.11 | 1.38 | 1.19 | 1.33 | 1.31 | 0.92 | 0.94 | 1 | HGG3 |
| 517374 | 1.00 | 0.00 to 1.71 | 1.40 | 1.09 | 1.29 | 1.37 | 0.00 | 0.00 | 1.71 | 1.07 | 1.10 | 1 | HGG3 |
| 5266376 | 1.26 | 0.83 to 1.71 | 1.24 | 0.89 | 1.35 | 1.28 | 1.21 | 1.21 | 1.59 | 1.71 | 0.83 | 1 | HGG3 |
| 1251065 | 1.35 | 0.97 to 1.59 | 1.45 | 0.97 | 1.24 | 1.54 | 1.45 | 1.59 | 1.40 | 1.19 | 1.25 | 1 | HGG3 |
| 3621521 | 0.42 | 0.00 to 3.44 | 0.00 | 0.38 | 0.00 | 3.44 | 0.00 | 0.00 | 0.00 | 0.00 | 0.00 | 1 | HGG3 |
| 664625 | 1.05 | 0.00 to 1.59 | 1.47 | 1.37 | 1.42 | 1.59 | 0.00 | 1.54 | 0.00 | 0.97 | 1.08 | 1 | HGO3 |
| 668460 | 1.28 | 0.77 to 1.54 | 1.26 | 0.77 | 1.24 | 1.45 | 1.41 | 1.54 | 1.42 | 1.26 | 1.12 | 1 | HGG3 |
| 893224 | 1.05 | 0.68 to 1.35 | 1.20 | 0.77 | 1.10 | 1.35 | 1.26 | 1.24 | 1.12 | 0.69 | 0.68 | 1 | HGG3 |
| 2545486 | 1.57 | 1.12 to 1.98 | 1.54 | 1.24 | 1.12 | 1.56 | 1.90 | 1.85 | 1.98 | 1.60 | 1.37 | 2 | HGG3 |
| 3158828 | 1.64 | 1.22 to 1.94 | 1.56 | 1.22 | 1.59 | 1.90 | 1.84 | 1.88 | 1.94 | 1.28 | 1.51 | 2 | HGG3 |
| 5266015 | 2.42 | 2.09 to 2.68 | 2.44 | 2.09 | 2.35 | 2.68 | 2.52 | 2.64 | 2.64 | 2.15 | 2.28 | 2 | HGG3 |
| 4402555 | 2.20 | 1.93 to 2.39 | 2.33 | 1.93 | 1.98 | 2.39 | 2.33 | 2.36 | 2.38 | 2.07 | 2.05 | 2 | HGG3 |
| 5293028 | 1.48 | 1.19 to 1.75 | 1.53 | 1.19 | 1.51 | 1.49 | 1.40 | 1.46 | 1.75 | 1.58 | 1.42 | 2 | HGG3 |
| 5322365 | 1.41 | 1.09 to 1.69 | 1.43 | 1.09 | 1.36 | 1.69 | 1.49 | 1.59 | 1.56 | 1.16 | 1.33 | 2 | HGG3 |
| 2343348 | 1.87 | 1.55 to 2.27 | 1.55 | 1.61 | 1.97 | 1.98 | 2.27 | 2.10 | 1.95 | 1.69 | 1.72 | 2 | HGG3 |
| 1786554 | 1.52 | 1.26 to 1.77 | 1.60 | 1.29 | 1.53 | 1.77 | 1.53 | 1.76 | 1.62 | 1.26 | 1.28 | 2 | HGG3 |
| 5508135 | 1.66 | 1.29 to 1.91 | 1.84 | 1.29 | 1.69 | 1.89 | 1.66 | 1.91 | 1.72 | 1.29 | 1.68 | 2 | HGG3 |
| 5512044 | 1.78 | 1.34 to 2.05 | 1.82 | 1.50 | 1.74 | 2.02 | 2.05 | 2.02 | 1.88 | 1.34 | 1.64 | 2 | HGG3 |
| 554654 | 1.70 | 1.15 to 2.35 | 1.98 | 1.76 | 2.35 | 1.74 | 1.83 | 1.46 | 1.56 | 1.15 | 1.42 | 2 | HGG3 |
| 3074113 | 1.98 | 1.65 to 2.29 | 2.00 | 1.76 | 1.98 | 2.21 | 2.24 | 2.29 | 2.01 | 1.66 | 1.65 | 2 | HGG3 |
| 621543 | 1.77 | 1.24 to 2.07 | 1.68 | 1.24 | 1.90 | 1.90 | 1.93 | 1.89 | 2.07 | 1.84 | 1.49 | 2 | HGG3 |
| 4912315 | 1.91 | 1.24 to 2.49 | 1.82 | 1.83 | 1.92 | 1.57 | 2.25 | 1.70 | 2.49 | 2.36 | 1.24 | 2 | HGG3 |
| 4253809 | 2.11 | 1.73 to 2.66 | 2.05 | 1.73 | 2.07 | 2.24 | 2.06 | 2.06 | 2.28 | 2.66 | 1.81 | 2 | HGG3 |
| 2972013 | 1.43 | 1.04 to 1.68 | 1.40 | 1.04 | 1.37 | 1.68 | 1.56 | 1.60 | 1.54 | 1.18 | 1.47 | 2 | HGG3 |
| 748477 | 1.55 | 1.01 to 1.85 | 1.38 | 1.01 | 1.65 | 1.85 | 1.71 | 1.71 | 1.79 | 1.52 | 1.34 | 2 | HGG3 |
| 5102731 | 1.83 | 1.39 to 2.25 | 1.71 | 1.39 | 1.88 | 2.25 | 1.76 | 1.87 | 2.02 | 1.82 | 1.75 | 2 | HGG3 |
| 3732960 | 0.62 | 0.01 to 2.45 | 0.17 | 0.71 | 0.50 | 0.04 | 0.61 | 0.01 | 0.48 | 2.45 | 0.66 | 3 | HGG3 |
| 4232507 | 0.73 | 0.00 to 1.76 | 0.00 | 1.17 | 0.65 | 0.00 | 0.00 | 1.76 | 0.00 | 1.36 | 1.60 | 3 | HGG3 |
| 4247396 | 0.51 | 0.00 to 1.47 | 0.00 | 0.95 | 1.10 | 0.00 | 1.47 | 0.00 | 0.00 | 1.09 | 0.00 | 3 | HGG3 |
| 1482166 | 0.23 | −0.12 to 1.51 | 0.15 | 0.10 | −0.12 | −0.05 | 0.24 | 0.00 | 0.11 | 0.16 | 1.51 | 3 | HGG3 |
| 1560380 | 0.31 | 0.00 to 1.48 | 0.00 | 1.33 | 1.48 | 0.00 | 0.00 | 0.00 | 0.00 | 0.00 | 0.00 | 3 | HGG3 |
| 569348 | 0.42 | 0.00 to 2.84 | 0.00 | 0.56 | 0.40 | 0.00 | 0.00 | 0.00 | 0.00 | 2.84 | 0.00 | 3 | HGG3 |
| 2195427 | 0.17 | 0.00 to 1.49 | 0.00 | 1.49 | 0.00 | 0.00 | 0.00 | 0.00 | 0.00 | 0.00 | 0.00 | 3 | HGG3 |
| 646463 | 0.37 | 0.00 to 1.36 | 0.00 | 0.87 | 1.07 | 0.00 | 0.00 | 1.36 | 0.00 | 0.00 | 0.00 | 3 | HGG3 |
| 2707635 | 0.66 | −0.16 to 2.79 | 0.23 | 0.53 | 0.29 | 0.22 | 0.44 | 0.07 | −0.16 | 2.79 | 1.49 | 3 | HGG3 |
| 5275515 | −0.17 | −1.82 to 0.30 | 0.00 | 0.30 | 0.00 | −1.82 | 0.00 | 0.00 | 0.00 | 0.00 | 0.00 | 3 | HGG3 |
| 3411051 | −0.14 | −1.60 to 0.15 | 0.09 | 0.15 | 0.12 | 0.00 | −1.60 | 0.00 | 0.00 | 0.00 | 0.00 | 3 | HGG3 |
| 699113 | 0.49 | 0.00 to 2.57 | 0.00 | 1.83 | 0.00 | 0.00 | 0.00 | 0.00 | 0.00 | 2.57 | 0.00 | 3 | HGG3 |
| 3569151 | 0.16 | 0.00 to 1.46 | 0.00 | 1.46 | 0.00 | 0.00 | 0.00 | 0.00 | 0.00 | 0.00 | 0.00 | 3 | HGG3 |
| 3729593 | 0.41 | 0.00 to 1.36 | 0.00 | 1.14 | 1.18 | 0.00 | 0.00 | 0.00 | 0.00 | 0.00 | 1.36 | 3 | HGG3 |
| 3172265 | 3.66 | 3.35 to 4.09 | 3.84 | 3.47 | 3.95 | 4.09 | 3.44 | 3.42 | 3.72 | 3.62 | 3.35 | 4 | HGG3 |
| 3069190 | 3.84 | 3.47 to 4.15 | 3.88 | 3.47 | 3.91 | 4.03 | 3.89 | 4.15 | 4.06 | 3.65 | 3.54 | 4 | HGG3 |
| 3068978 | 1.99 | 0.00 to 3.47 | 0.00 | 2.28 | 2.58 | 0.00 | 3.47 | 3.29 | 3.12 | 0.00 | 3.19 | 5 | HGG3 |
| 872017 | 1.46 | 0.00 to 1.86 | 1.68 | 1.42 | 1.58 | 0.00 | 1.85 | 1.86 | 1.81 | 1.40 | 1.57 | 6 | HGG3 |
| 1259841 | 1.09 | 0.55 to 1.50 | 0.88 | 0.55 | 0.91 | 1.23 | 1.13 | 1.50 | 1.22 | 1.07 | 1.29 | 0 | HGG4 |
| 439415 | 1.06 | 0.81 to 1.40 | 0.87 | 0.95 | 1.07 | 1.40 | 1.10 | 0.95 | 0.81 | 1.08 | 1.34 | 0 | HGG4 |
| 434751 | 1.84 | 1.55 to 2.04 | 1.95 | 1.55 | 1.95 | 2.00 | 1.88 | 2.04 | 1.88 | 1.71 | 1.58 | 0 | HGG4 |
| 409209 | 1.06 | 0.68 to 1.47 | 0.98 | 0.68 | 1.10 | 1.07 | 1.27 | 1.47 | 1.32 | 0.71 | 0.95 | 0 | HGG4 |
| 1448572 | 0.91 | 0.68 to 1.41 | 0.68 | 0.70 | 0.69 | 1.18 | 0.91 | 1.08 | 0.78 | 0.78 | 1.41 | 0 | HGG4 |
| 4077648 | 1.38 | 0.66 to 1.98 | 0.89 | 0.66 | 1.13 | 1.56 | 1.62 | 1.98 | 1.46 | 1.25 | 1.85 | 0 | HGG4 |
| 1611629 | 0.89 | 0.68 to 1.40 | 0.74 | 0.69 | 0.92 | 1.40 | 0.74 | 0.92 | 0.80 | 0.68 | 1.16 | 0 | HGG4 |
| 2196870 | 1.16 | 0.88 to 1.72 | 0.99 | 0.88 | 1.26 | 1.72 | 0.99 | 1.30 | 1.03 | 0.97 | 1.26 | 0 | HGG4 |
| 2227273 | 1.37 | 0.77 to 1.81 | 1.14 | 0.77 | 1.15 | 1.72 | 1.50 | 1.81 | 1.51 | 1.35 | 1.33 | 0 | HGG4 |
| 1716458 | 1.09 | 0.67 to 1.43 | 0.86 | 0.67 | 1.09 | 1.31 | 1.18 | 1.43 | 1.11 | 0.92 | 1.20 | 0 | HGG4 |
| 2428314 | 1.01 | 0.61 to 1.33 | 0.61 | 0.89 | 1.06 | 1.17 | 0.99 | 1.21 | 0.94 | 0.91 | 1.33 | 0 | HGG4 |
| 1740179 | 1.04 | 0.73 to 1.49 | 0.82 | 0.73 | 1.04 | 1.49 | 1.10 | 1.33 | 0.93 | 0.75 | 1.15 | 0 | HGG4 |

TABLE 9-continued

| Clone ID | Ave DE t/MAH | Range | mean DE t/MAH 1 μM, 1 hr | mean DE t/MAH 1 μM, 3 hr | mean DE t/MAH 1 μM, 6 hr | mean DE t/MAH 10 μM, 1 hr | mean DE t/MAH 10 μM, 3 hr | mean DE t/MAH 10 μM, 6 hr | mean DE t/MAH 100 μM, 1 hr | mean DE t/MAH 100 μM, 3 hr | mean DE t/MAH 100 μM, 6 hr | Cluster | GEM |
|---|---|---|---|---|---|---|---|---|---|---|---|---|---|
| 346017 | 0.78 | 0.40 to 1.40 | 0.40 | 0.40 | 0.55 | 1.40 | 0.83 | 1.25 | 0.70 | 0.61 | 0.89 | 0 | HGG4 |
| 3449615 | 0.76 | 0.30 to 1.43 | 0.50 | 0.30 | 0.50 | 1.04 | 0.79 | 1.14 | 0.64 | 0.53 | 1.43 | 0 | HGG4 |
| 1913334 | 1.56 | 1.16 to 2.06 | 1.34 | 1.16 | 1.66 | 1.94 | 1.73 | 2.06 | 1.53 | 1.24 | 1.33 | 0 | HGG4 |
| 2350594 | 1.35 | 0.95 to 1.86 | 0.95 | 1.10 | 1.41 | 1.86 | 1.12 | 1.68 | 1.23 | 1.23 | 1.54 | 0 | HGG4 |
| 2408333 | 1.55 | 0.00 to 2.55 | 1.52 | 1.47 | 1.89 | 2.55 | 1.56 | 0.00 | 1.71 | 1.62 | 1.63 | 0 | HGG4 |
| 2756747 | 1.00 | 0.80 to 1.53 | 0.86 | 0.80 | 1.11 | 1.53 | 0.94 | 1.11 | 0.80 | 0.80 | 1.01 | 0 | HGG4 |
| 2756587 | 1.08 | 0.80 to 1.65 | 0.80 | 0.81 | 1.13 | 1.65 | 1.04 | 1.27 | 0.90 | 0.93 | 1.15 | 0 | HGG4 |
| 1965856 | 1.64 | 1.22 to 2.37 | 1.43 | 1.22 | 1.65 | 1.91 | 1.78 | 2.37 | 1.74 | 1.44 | 1.26 | 0 | HGG4 |
| 2006043 | 1.49 | 1.12 to 2.03 | 1.31 | 1.12 | 1.32 | 1.89 | 1.53 | 2.03 | 1.47 | 1.34 | 1.39 | 0 | HGG4 |
| 2007730 | 1.40 | 0.71 to 2.21 | 0.88 | 0.71 | 0.99 | 1.48 | 1.59 | 2.21 | 1.47 | 1.35 | 1.88 | 0 | HGG4 |
| 2669871 | 1.02 | 0.81 to 1.44 | 0.94 | 0.86 | 1.19 | 0.97 | 0.86 | 1.30 | 0.81 | 0.82 | 1.44 | 0 | HGG4 |
| 2619275 | 1.33 | 0.76 to 1.79 | 1.02 | 0.76 | 1.19 | 1.54 | 1.44 | 1.79 | 1.41 | 1.19 | 1.66 | 0 | HGG4 |
| 2062085 | 1.32 | 0.87 to 1.85 | 0.97 | 0.87 | 1.26 | 1.61 | 1.41 | 1.85 | 1.47 | 1.44 | 1.01 | 0 | HGG4 |
| 2106010 | 1.65 | 1.32 to 2.16 | 1.38 | 1.32 | 1.83 | 2.16 | 1.63 | 1.94 | 1.53 | 1.47 | 1.63 | 0 | HGG4 |
| 2110482 | 1.48 | 0.97 to 2.18 | 1.06 | 0.97 | 1.32 | 1.61 | 1.66 | 2.18 | 1.72 | 1.42 | 1.36 | 0 | HGG4 |
| 5101167 | 1.07 | 0.60 to 1.47 | 0.88 | 0.60 | 1.11 | 1.47 | 1.23 | 1.45 | 0.93 | 0.78 | 1.18 | 0 | HGG4 |
| 5690026 | 1.50 | 1.13 to 2.03 | 1.26 | 1.18 | 1.55 | 2.03 | 1.61 | 1.80 | 1.37 | 1.13 | 1.55 | 0 | HGG4 |
| 761282 | 1.04 | 0.72 to 1.44 | 1.00 | 0.75 | 1.13 | 1.44 | 1.03 | 1.17 | 1.05 | 1.03 | 0.72 | 0 | HGG4 |
| 998615 | 0.85 | 0.00 to 1.62 | 0.87 | 0.66 | 1.07 | 1.45 | 1.20 | 1.62 | 0.00 | 0.76 | 0.00 | 0 | HGG4 |
| 1946155 | 0.64 | 0.00 to 1.41 | 0.78 | 0.76 | 0.96 | 1.41 | 0.92 | 0.00 | 0.00 | 0.91 | 0.00 | 1 | HGG4 |
| 2266959 | 0.29 | 0.00 to 1.50 | 0.00 | 1.09 | 1.50 | 0.00 | 0.00 | 0.00 | 0.00 | 0.00 | 0.00 | 1 | HGG4 |
| 2267466 | 0.43 | 0.00 to 1.39 | 1.29 | 1.16 | 1.39 | 0.00 | 0.00 | 0.00 | 0.00 | 0.00 | 0.00 | 1 | HGG4 |
| 2268803 | 0.40 | 0.00 to 2.13 | 0.53 | 0.42 | 0.56 | 0.00 | 0.00 | 0.00 | 0.00 | 0.00 | 2.13 | 1 | HGG4 |
| 2405487 | 0.63 | 0.00 to 1.44 | 0.90 | 0.80 | 1.20 | 1.44 | 0.00 | 0.00 | 0.00 | 1.29 | 0.00 | 1 | HGG4 |
| 2404746 | 0.49 | 0.00 to 1.74 | 0.86 | 0.80 | 0.98 | 1.74 | 0.00 | 0.00 | 0.00 | 0.00 | 0.00 | 1 | HGG4 |
| 2410066 | 0.70 | 0.00 to 1.66 | 1.00 | 1.01 | 1.29 | 1.66 | 0.00 | 0.00 | 0.00 | 1.33 | 0.00 | 1 | HGG4 |
| 3149570 | 0.68 | 0.00 to 1.64 | 0.97 | 0.95 | 1.24 | 1.64 | 0.00 | 0.00 | 0.00 | 1.31 | 0.00 | 1 | HGG4 |
| 3220149 | 0.31 | 0.00 to 1.47 | 0.00 | 1.30 | 1.47 | 0.00 | 0.00 | 0.00 | 0.00 | 0.00 | 0.00 | 1 | HGG4 |
| 3253978 | 0.36 | 0.00 to 2.67 | 0.00 | 0.30 | 0.25 | 2.67 | 0.00 | 0.00 | 0.00 | 0.00 | 0.00 | 1 | HGG4 |
| 3522739 | 0.38 | 0.00 to 1.33 | 1.13 | 0.97 | 1.33 | 0.00 | 0.00 | 0.00 | 0.00 | 0.00 | 0.00 | 1 | HGG4 |
| 417432 | 0.57 | 0.00 to 1.56 | 0.86 | 0.80 | 1.10 | 1.56 | 0.00 | 0.00 | 0.00 | 0.85 | 0.00 | 1 | HGG4 |
| 509839 | 1.02 | 0.00 to 2.10 | 1.25 | 1.35 | 1.74 | 2.10 | 1.38 | 0.00 | 0.00 | 1.36 | 0.00 | 1 | HGG4 |
| 1645304 | 0.53 | 0.00 to 1.42 | 0.78 | 0.77 | 0.94 | 1.42 | 0.00 | 0.00 | 0.00 | 0.88 | 0.00 | 1 | HGG4 |
| 1683583 | 0.59 | 0.00 to 1.49 | 0.75 | 0.68 | 1.00 | 1.49 | 0.83 | 0.00 | 0.00 | 0.55 | 0.00 | 1 | HGG4 |
| 1730026 | 0.85 | 0.00 to 1.49 | 0.91 | 1.06 | 1.06 | 1.49 | 1.17 | 0.00 | 1.04 | 0.95 | 0.00 | 1 | HGG4 |
| 1927771 | 0.52 | 0.00 to 1.39 | 0.78 | 0.54 | 0.79 | 0.00 | 1.15 | 1.39 | 0.00 | 0.00 | 0.00 | 1 | HGG4 |
| 3042227 | −1.70 | −2.22 to −0.96 | −1.83 | −1.50 | −1.61 | −1.91 | −1.64 | −2.22 | −1.73 | −0.96 | −1.88 | 2 | HGG4 |
| 1953051 | −1.08 | −1.40 to −0.70 | −0.98 | −1.19 | −1.04 | −1.40 | −1.01 | −1.34 | −1.23 | −0.70 | −0.78 | 2 | HGG4 |
| 2786442 | −1.40 | −1.83 to −0.77 | −1.83 | −1.39 | −1.36 | −1.68 | −1.46 | −1.40 | −1.77 | −0.77 | −0.92 | 2 | HGG4 |
| 693783 | −0.87 | −1.52 to 0.00 | −1.16 | −0.70 | −0.81 | −1.00 | −1.03 | −1.52 | 0.00 | −0.68 | −0.96 | 2 | HGG4 |
| 2055569 | −1.15 | −1.62 to −0.08 | −0.76 | −1.43 | −1.38 | −0.85 | −1.27 | −1.61 | −0.08 | −1.36 | −1.62 | 2 | HGG4 |
| 3254430 | −0.77 | −1.35 to 0.00 | −1.23 | −0.72 | −0.91 | −1.17 | −0.97 | −1.35 | 0.00 | −0.60 | 0.00 | 2 | HGG4 |
| 1857850 | −2.07 | −2.40 to −1.48 | −2.37 | −1.83 | −2.15 | −2.33 | −2.00 | −2.40 | −2.29 | −1.48 | −1.76 | 2 | HGG4 |
| 1857664 | −0.92 | −1.50 to 0.02 | −1.50 | −0.69 | −0.81 | −1.32 | −0.69 | −1.06 | −1.44 | 0.02 | −0.75 | 2 | HGG4 |
| 2806983 | −0.88 | −1.40 to 0.00 | −1.05 | −1.00 | −0.80 | 0.00 | −0.97 | −1.40 | −1.02 | −0.74 | −0.91 | 2 | HGG4 |
| 1449819 | −1.30 | −1.97 to −0.27 | −0.65 | −1.79 | −1.85 | −0.27 | −1.64 | −1.71 | −0.48 | −1.35 | −1.97 | 2 | HGG4 |
| 1383138 | −1.03 | −1.35 to −0.69 | −0.86 | −1.17 | −1.03 | −0.69 | −1.34 | −1.35 | −0.71 | −1.07 | −1.09 | 2 | HGG4 |
| 269310 | −0.89 | −1.38 to −0.61 | −0.84 | −0.73 | −0.64 | −0.64 | −0.89 | −1.38 | −0.96 | −0.61 | −1.31 | 2 | HGG4 |
| 495808 | −1.04 | −1.35 to −0.40 | −1.19 | −1.21 | −1.12 | −1.23 | −1.02 | −1.35 | −0.98 | −0.40 | −0.86 | 2 | HGG4 |
| 2278772 | 3.17 | 2.41 to 4.02 | 2.51 | 2.41 | 2.88 | 3.23 | 3.21 | 4.02 | 3.44 | 3.46 | 3.34 | 3 | HGG4 |
| 3191030 | 2.29 | 1.80 to 2.54 | 2.07 | 1.80 | 2.54 | 2.45 | 2.35 | 2.40 | 2.26 | 2.39 | 2.32 | 3 | HGG4 |
| 2581075 | 4.02 | 3.39 to 4.52 | 3.75 | 3.39 | 3.90 | 4.30 | 4.11 | 4.52 | 4.21 | 3.92 | 4.11 | 3 | HGG4 |
| 1964758 | 2.34 | 1.91 to 2.75 | 2.04 | 1.91 | 2.36 | 2.64 | 2.43 | 2.75 | 2.43 | 2.18 | 2.34 | 3 | HGG4 |
| 1365045 | 2.00 | 1.53 to 2.57 | 1.83 | 1.53 | 1.90 | 2.11 | 2.08 | 2.57 | 1.98 | 1.80 | 2.18 | 3 | HGG4 |
| 1370137 | 2.31 | 0.00 to 3.07 | 2.24 | 2.12 | 2.72 | 3.07 | 2.67 | 2.76 | 0.00 | 2.25 | 2.95 | 3 | HGG4 |
| 3016137 | 2.06 | 1.35 to 2.55 | 1.62 | 1.35 | 1.73 | 2.28 | 2.15 | 2.55 | 2.24 | 2.30 | 2.37 | 3 | HGG4 |
| 435549 | 0.81 | 0.00 to 4.32 | 0.33 | 0.37 | 0.48 | 4.32 | 1.82 | 0.00 | 0.00 | 0.00 | 0.00 | 4 | HGG4 |
| 489820 | −0.27 | −2.46 to 0.19 | 0.02 | −0.15 | 0.02 | 0.19 | 0.02 | −2.46 | −0.01 | −0.10 | 0.00 | 5 | HGG4 |
| 2013251 | 1.58 | 0.00 to 2.51 | 1.69 | 1.59 | 2.14 | 2.51 | 2.17 | 2.37 | 0.00 | 1.80 | 0.00 | 6 | HGG4 |

TABLE 10

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 1004382 | 1.27 | 1.08 to 1.36 | 1.28 | 1.33 | 1.34 | 1.34 | 1.36 | 1.08 | 1.28 | 1.14 | 1.25 | 0 | HGG1 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 1210839 | 1.35 | 1.16 to 1.50 | 1.45 | 1.45 | 1.50 | 1.32 | 1.39 | 1.20 | 1.39 | 1.16 | 1.26 | 0 | HGG1 |
| 1241484 | 1.42 | 1.20 to 1.58 | 1.55 | 1.58 | 1.54 | 1.40 | 1.54 | 1.27 | 1.40 | 1.20 | 1.34 | 0 | HGG1 |
| 1268277 | 1.27 | 0.97 to 1.59 | 1.41 | 1.44 | 1.57 | 1.17 | 1.59 | 1.12 | 1.08 | 0.97 | 1.04 | 0 | HGG1 |
| 4203937 | 0.76 | 0.41 to 1.35 | 1.35 | 1.27 | 1.21 | 0.60 | 0.41 | 0.44 | 0.54 | 0.53 | 0.50 | 0 | HGG1 |
| 4251117 | 0.98 | 0.69 to 1.33 | 1.27 | 1.26 | 1.33 | 0.99 | 0.93 | 0.82 | 0.85 | 0.72 | 0.69 | 0 | HGG1 |
| 4284384 | 1.13 | 0.85 to 1.48 | 1.42 | 1.42 | 1.48 | 1.20 | 0.95 | 0.85 | 1.04 | 0.96 | 0.88 | 0 | HGG1 |
| 2482388 | 1.19 | 0.98 to 1.52 | 1.32 | 1.39 | 1.52 | 1.22 | 1.26 | 0.98 | 1.02 | 0.98 | 1.03 | 0 | HGG1 |
| 136073 | 1.25 | 0.97 to 1.60 | 1.60 | 1.55 | 1.44 | 1.09 | 1.00 | 0.97 | 1.37 | 1.10 | 1.10 | 0 | HGG1 |
| 139949 | 1.35 | 0.98 to 1.72 | 1.68 | 1.28 | 1.28 | 1.46 | 1.22 | 1.23 | 1.72 | 1.25 | 0.98 | 0 | HGG1 |
| 143765 | 1.07 | 0.72 to 1.35 | 1.21 | 1.35 | 1.33 | 0.93 | 1.17 | 1.14 | 0.95 | 0.72 | 0.80 | 0 | HGG1 |
| 1944123 | 1.31 | 1.07 to 1.55 | 1.55 | 1.53 | 1.54 | 1.28 | 1.34 | 1.16 | 1.24 | 1.07 | 1.07 | 0 | HGG1 |
| 1956982 | 1.38 | 1.02 to 1.74 | 1.72 | 1.74 | 1.48 | 1.12 | 1.12 | 1.02 | 1.45 | 1.44 | 1.35 | 0 | HGG1 |
| 4289063 | 1.22 | 0.91 to 1.54 | 1.54 | 1.44 | 1.41 | 1.16 | 1.23 | 1.15 | 1.15 | 0.91 | 0.99 | 0 | HGG1 |
| 4403805 | 1.12 | 0.83 to 1.44 | 1.33 | 1.39 | 1.44 | 1.05 | 1.18 | 0.92 | 1.03 | 0.90 | 0.83 | 0 | HGG1 |
| 4554722 | 1.08 | 0.71 to 1.42 | 1.42 | 1.16 | 1.35 | 1.09 | 1.37 | 1.10 | 0.82 | 0.71 | 0.73 | 0 | HGG1 |
| 1521272 | 1.40 | 1.16 to 1.53 | 1.50 | 1.48 | 1.53 | 1.41 | 1.41 | 1.16 | 1.43 | 1.33 | 1.31 | 0 | HGG1 |
| 4978708 | 1.41 | 1.20 to 1.61 | 1.56 | 1.60 | 1.61 | 1.40 | 1.49 | 1.20 | 1.30 | 1.23 | 1.26 | 0 | HGG1 |
| 2061171 | 1.26 | 1.14 to 1.41 | 1.41 | 1.32 | 1.30 | 1.29 | 1.36 | 1.18 | 1.19 | 1.15 | 1.14 | 0 | HGG1 |
| 1604437 | 1.18 | 1.02 to 1.39 | 1.20 | 1.18 | 1.15 | 1.23 | 1.39 | 1.02 | 1.23 | 1.08 | 1.15 | 0 | HGG1 |
| 1609387 | 1.32 | 1.09 to 1.48 | 1.48 | 1.44 | 1.42 | 1.27 | 1.44 | 1.20 | 1.43 | 1.09 | 1.11 | 0 | HGG1 |
| 1610828 | 1.28 | 1.12 to 1.46 | 1.46 | 1.39 | 1.37 | 1.29 | 1.32 | 1.18 | 1.19 | 1.12 | 1.17 | 0 | HGG1 |
| 531505 | 1.24 | 0.95 to 1.40 | 1.38 | 1.33 | 1.37 | 1.21 | 1.40 | 1.29 | 1.16 | 0.95 | 1.08 | 0 | HGG1 |
| 5397446 | 1.22 | 1.05 to 1.33 | 1.16 | 1.30 | 1.22 | 1.30 | 1.26 | 1.05 | 1.12 | 1.23 | 1.33 | 0 | HGG1 |
| 622565 | 1.20 | 1.02 to 1.45 | 1.45 | 1.32 | 1.40 | 1.23 | 1.21 | 1.03 | 1.10 | 1.02 | 1.04 | 0 | HGG1 |
| 2697275 | 1.45 | 1.20 to 1.72 | 1.57 | 1.63 | 1.72 | 1.38 | 1.53 | 1.20 | 1.37 | 1.32 | 1.31 | 0 | HGG1 |
| 2756333 | 1.42 | 1.21 to 1.66 | 1.58 | 1.58 | 1.66 | 1.38 | 1.59 | 1.23 | 1.36 | 1.23 | 1.21 | 0 | HGG1 |
| 279898 | 1.30 | 0.03 to 2.45 | 0.26 | 1.46 | 1.65 | 0.03 | 1.45 | 1.42 | 0.98 | 1.99 | 2.45 | 0 | HGG1 |
| 3075994 | 1.18 | 1.01 to 1.38 | 1.22 | 1.19 | 1.24 | 1.32 | 1.38 | 1.02 | 1.18 | 1.01 | 1.09 | 0 | HGG1 |
| 3108506 | 1.04 | 0.60 to 1.48 | 1.13 | 1.28 | 1.48 | 0.97 | 1.34 | 1.15 | 0.77 | 0.60 | 0.61 | 0 | HGG1 |
| 3497231 | 1.39 | 1.16 to 1.72 | 1.63 | 1.72 | 1.60 | 1.35 | 1.31 | 1.29 | 1.29 | 1.17 | 1.16 | 0 | HGG1 |
| 3606947 | 1.19 | 0.89 to 1.47 | 1.47 | 1.47 | 1.47 | 1.15 | 0.99 | 0.89 | 1.20 | 1.01 | 1.03 | 0 | HGG1 |
| 3687607 | 1.17 | 0.98 to 1.32 | 1.32 | 1.29 | 1.20 | 1.20 | 1.25 | 1.02 | 1.23 | 0.98 | 1.04 | 0 | HGG1 |
| 371201 | 1.17 | 0.92 to 1.38 | 1.01 | 1.06 | 0.92 | 1.38 | 1.22 | 1.15 | 1.37 | 1.18 | 1.21 | 0 | HGG1 |
| 4021009 | 1.27 | 1.02 to 1.48 | 1.44 | 1.47 | 1.48 | 1.30 | 1.27 | 1.02 | 1.19 | 1.12 | 1.10 | 0 | HGG1 |
| 2403438 | 1.21 | 0.93 to 1.38 | 1.33 | 1.24 | 0.93 | 1.17 | 1.38 | 1.24 | 1.08 | 1.24 | 1.31 | 0 | HGG1 |
| 2055814 | −1.23 | −1.38 to −0.94 | −1.18 | −1.31 | −1.14 | −1.26 | −1.38 | −1.30 | −0.94 | −1.25 | −1.29 | 1 | HGG1 |

TABLE 10-continued

| Clone ID | Ave DE t/Bude | Range | mean DE t/Bude 1 µM, 1 hr | mean DE t/Bude 1 µM, 3 hr | mean DE t/Bude 1 µM, 6 hr | mean DE t/Bude 10 µM, 1 hr | mean DE t/Bude 10 µM, 3 hr | mean DE t/Bude 10 µM, 6 hr | mean DE t/Bude 100 µM, 1 hr | mean DE t/Bude 100 µM, 3 hr | mean DE t/Bude 100 µM, 6 hr | Cluster | GEM |
|---|---|---|---|---|---|---|---|---|---|---|---|---|---|
| 891072 | −1.46 | −1.77 to −1.25 | −1.46 | −1.35 | −1.25 | −1.48 | −1.77 | −1.37 | −1.52 | −1.56 | −1.33 | 1 | HGG1 |
| 2061528 | −1.41 | −1.74 to −1.16 | −1.61 | −1.31 | −1.34 | −1.30 | −1.16 | −1.25 | −1.74 | −1.59 | −1.42 | 1 | HGG1 |
| 3126622 | −1.27 | −1.51 to −1.02 | −1.35 | −1.33 | −1.24 | −1.41 | −1.51 | −1.04 | −1.02 | −1.30 | −1.20 | 1 | HGG1 |
| 1441245 | −1.29 | −1.50 to −1.10 | −1.38 | −1.29 | −1.28 | −1.10 | −1.16 | −1.10 | −1.46 | −1.50 | −1.31 | 1 | HGG1 |
| 2623304 | −1.19 | −1.45 to −0.93 | −1.16 | −1.06 | −0.93 | −1.14 | −1.24 | −1.19 | −1.27 | −1.45 | −1.31 | 1 | HGG1 |
| 3397390 | −1.07 | −1.38 to −0.62 | −1.05 | −1.19 | −0.96 | −1.09 | −0.62 | −1.07 | −0.92 | −1.35 | −1.38 | 1 | HGG1 |
| 3408804 | −1.24 | −1.41 to −1.00 | −1.33 | −1.36 | −1.30 | −1.05 | −1.27 | −1.00 | −1.20 | −1.41 | −1.22 | 1 | HGG1 |
| 3451645 | −1.28 | −1.76 to −0.80 | −1.04 | −1.29 | −1.22 | −1.27 | −1.76 | −1.38 | −0.80 | −1.41 | −1.38 | 1 | HGG1 |
| 2132606 | −1.17 | −1.47 to −0.93 | −1.47 | −1.34 | −1.14 | −1.28 | −1.19 | −1.09 | −1.02 | −1.04 | −0.93 | 1 | HGG1 |
| 2132607 | −1.25 | −1.47 to −1.02 | −1.21 | −1.16 | −1.02 | −1.29 | −1.47 | −1.02 | −1.36 | −1.47 | −1.27 | 1 | HGG1 |
| 3679667 | −1.36 | −1.57 to −1.18 | −1.36 | −1.33 | −1.31 | −1.22 | −1.33 | −1.18 | −1.40 | −1.57 | −1.49 | 1 | HGG1 |
| 1619292 | −1.38 | −1.56 to −1.10 | −1.46 | −1.45 | −1.39 | −1.13 | −1.10 | −1.40 | −1.41 | −1.56 | −1.56 | 1 | HGG1 |
| 2287724 | −1.06 | −1.34 to −0.85 | −1.34 | −1.21 | −1.06 | −0.98 | −1.11 | −1.02 | −0.92 | −1.02 | −0.85 | 1 | HGG1 |
| 1652328 | −1.34 | −1.74 to −1.15 | −1.24 | −1.41 | −1.15 | −1.51 | −1.74 | −1.15 | −1.16 | −1.34 | −1.32 | 1 | HGG1 |
| 3681722 | −1.23 | −1.54 to −1.05 | −1.54 | −1.46 | −1.10 | −1.26 | −1.17 | −1.22 | −1.06 | −1.21 | −1.05 | 1 | HGG1 |
| 3686603 | −1.13 | −1.52 to −0.84 | −1.14 | −1.15 | −0.90 | −1.28 | −1.52 | −0.84 | −1.25 | −1.18 | −0.88 | 1 | HGG1 |
| 3721985 | −1.10 | −1.39 to −0.88 | −1.11 | −1.12 | −0.88 | −1.15 | −1.39 | −1.03 | −1.10 | −1.16 | −0.94 | 1 | HGG1 |
| 1740474 | −1.46 | −1.55 to −1.35 | −1.43 | −1.45 | −1.38 | −1.55 | −1.53 | −1.50 | −1.35 | −1.55 | −1.44 | 1 | HGG1 |
| 380006 | −1.05 | −1.38 to −0.86 | −1.09 | −1.06 | −0.86 | −1.00 | −1.38 | −1.08 | −0.89 | −1.12 | −0.98 | 1 | HGG1 |
| 1807155 | −1.07 | −1.39 to −0.75 | −0.75 | −1.03 | −0.96 | −1.00 | −1.30 | −1.12 | −0.77 | −1.31 | −1.39 | 1 | HGG1 |
| 1833362 | −1.25 | −1.49 to −0.96 | −1.12 | −1.37 | −0.96 | −1.36 | −1.39 | −0.96 | −1.29 | −1.49 | −1.29 | 1 | HGG1 |
| 1840426 | −1.36 | −1.58 to −1.09 | −1.48 | −1.43 | −1.18 | −1.58 | −1.55 | −1.09 | −1.28 | −1.41 | −1.22 | 1 | HGG1 |
| 41479 | −1.41 | −1.91 to −0.97 | −1.32 | −1.41 | −1.27 | −1.57 | −1.91 | −1.39 | −0.97 | −1.55 | −1.31 | 1 | HGG1 |
| 2471835 | −1.03 | −1.36 to −0.83 | −1.36 | −1.22 | −1.10 | −0.93 | −0.86 | −1.06 | −0.89 | −1.05 | −0.83 | 1 | HGG1 |
| 2839946 | −1.08 | −1.35 to −0.86 | −0.95 | −1.05 | −1.19 | −1.06 | −1.35 | −1.06 | −1.11 | −1.07 | −0.86 | 1 | HGG1 |
| 5291518 | −1.28 | −1.54 to −1.09 | −1.32 | −1.23 | −1.09 | −1.16 | −1.10 | −1.17 | −1.48 | −1.46 | −1.54 | 1 | HGG1 |
| 1910401 | −1.39 | −1.51 to −1.23 | −1.40 | −1.31 | −1.23 | −1.40 | −1.47 | −1.31 | −1.47 | −1.51 | −1.39 | 1 | HGG1 |
| 1930847 | −1.09 | −1.63 to −0.76 | −1.19 | −1.22 | −0.81 | −1.35 | −1.63 | −0.76 | −0.99 | −1.09 | −0.78 | 1 | HGG1 |
| 2767579 | −1.22 | −1.40 to −1.05 | −1.40 | −1.34 | −1.19 | −1.30 | −1.15 | −1.25 | −1.10 | −1.05 | −1.17 | 1 | HGG1 |
| 2769888 | −0.95 | −1.68 to −0.54 | −0.61 | −0.84 | −1.17 | −0.63 | −0.68 | −1.02 | −0.54 | −1.41 | −1.68 | 1 | HGG1 |
| 3606046 | 1.91 | 1.61 to 2.18 | 2.18 | 2.11 | 2.15 | 1.80 | 2.01 | 1.61 | 1.89 | 1.72 | 1.73 | 2 | HGG1 |
| 3595618 | 1.56 | 1.25 to 1.83 | 1.77 | 1.83 | 1.77 | 1.61 | 1.56 | 1.41 | 1.54 | 1.25 | 1.34 | 2 | HGG1 |
| 2511277 | 1.62 | 1.35 to 1.85 | 1.66 | 1.76 | 1.69 | 1.64 | 1.81 | 1.85 | 1.41 | 1.35 | 1.37 | 2 | HGG1 |
| 1342744 | 1.78 | 1.45 to 2.13 | 2.10 | 2.13 | 2.03 | 1.66 | 1.70 | 1.45 | 1.82 | 1.55 | 1.57 | 2 | HGG1 |
| 4092112 | 1.54 | 1.21 to 1.98 | 1.98 | 1.94 | 1.95 | 1.39 | 1.36 | 1.23 | 1.42 | 1.40 | 1.21 | 2 | HGG1 |
| 2516950 | 1.82 | 1.45 to 2.11 | 2.08 | 2.11 | 2.02 | 1.83 | 1.73 | 1.45 | 1.80 | 1.72 | 1.62 | 2 | HGG1 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 1459743 | 1.71 | 1.49 to 1.89 | 1.88 | 1.85 | 1.89 | 1.69 | 1.74 | 1.68 | 1.68 | 1.52 | 1.49 | 2 | HGG1 |
| 5509134 | 1.88 | 1.64 to 2.28 | 2.03 | 2.11 | 2.28 | 1.84 | 1.78 | 1.64 | 1.82 | 1.68 | 1.78 | 2 | HGG1 |
| 1560906 | 1.66 | 1.43 to 1.86 | 1.77 | 1.66 | 1.67 | 1.74 | 1.86 | 1.56 | 1.69 | 1.58 | 1.43 | 2 | HGG1 |
| 671717 | 1.51 | 1.28 to 1.71 | 1.66 | 1.65 | 1.71 | 1.52 | 1.65 | 1.28 | 1.49 | 1.31 | 1.35 | 2 | HGG1 |
| 3821432 | 1.54 | 1.18 to 1.86 | 1.86 | 1.79 | 1.76 | 1.48 | 1.40 | 1.18 | 1.63 | 1.40 | 1.41 | 2 | HGG1 |
| 2833342 | 1.55 | 1.34 to 1.75 | 1.71 | 1.75 | 1.74 | 1.59 | 1.51 | 1.34 | 1.56 | 1.35 | 1.40 | 2 | HGG1 |
| 1684617 | 1.79 | 1.56 to 2.05 | 1.93 | 1.90 | 2.05 | 1.73 | 2.05 | 1.63 | 1.69 | 1.56 | 1.58 | 2 | HGG1 |
| 3687719 | 1.70 | 1.36 to 1.98 | 1.98 | 1.92 | 1.86 | 1.82 | 1.59 | 1.36 | 1.69 | 1.46 | 1.57 | 2 | HGG1 |
| 2778441 | 1.82 | 1.58 to 2.13 | 2.09 | 2.13 | 2.06 | 1.76 | 1.69 | 1.64 | 1.70 | 1.70 | 1.58 | 2 | HGG1 |
| 1756875 | 1.51 | 1.27 to 1.80 | 1.72 | 1.67 | 1.80 | 1.37 | 1.57 | 1.27 | 1.52 | 1.34 | 1.36 | 2 | HGG1 |
| 2313349 | 1.76 | 1.52 to 1.96 | 1.94 | 1.96 | 1.94 | 1.70 | 1.77 | 1.52 | 1.83 | 1.58 | 1.62 | 2 | HGG1 |
| 2445967 | 1.61 | 1.30 to 1.78 | 1.75 | 1.78 | 1.63 | 1.70 | 1.54 | 1.30 | 1.72 | 1.55 | 1.54 | 2 | HGG1 |
| 2459765 | 1.48 | 1.25 to 1.76 | 1.76 | 1.74 | 1.75 | 1.41 | 1.42 | 1.27 | 1.47 | 1.29 | 1.25 | 2 | HGG1 |
| 459372 | 1.95 | 1.79 to 2.16 | 1.86 | 1.90 | 1.79 | 2.16 | 1.92 | 1.82 | 2.11 | 2.01 | 1.95 | 2 | HGG1 |
| 548114 | 1.81 | 1.70 to 1.88 | 1.82 | 1.83 | 1.8& | 1.87 | 1.80 | 1.70 | 1.79 | 1.78 | 1.87 | 2 | HGG1 |
| 1890576 | −1.55 | −1.82 to −1.28 | −1.82 | −1.71 | −1.49 | −1.59 | −1.49 | −1.52 | −1.55 | −1.49 | −1.28 | 3 | HGG1 |
| 1596220 | −1.81 | −2.19 to −1.52 | −1.76 | −1.75 | −1.64 | −2.02 | −2.19 | −1.52 | −1.84 | −1.95 | −1.64 | 3 | HGG1 |
| 2042056 | −1.64 | −2.07 to −1.05 | −1.99 | −1.77 | −1.37 | −1.72 | −1.55 | −1.44 | −2.07 | −1.79 | −1.05 | 3 | HGG1 |
| 2047730 | −1.56 | −1.87 to −1.32 | −1.37 | −1.50 | −1.32 | −1.65 | −1.87 | −1.56 | −1.60 | −1.64 | −1.55 | 3 | HGG1 |
| 3975209 | −1.59 | −1.82 to −1.41 | −1.82 | −1.41 | −1.52 | −1.76 | −1.42 | −1.49 | −1.75 | −1.51 | −1.64 | 3 | HGG1 |
| 1868536 | −1.66 | −1.91 to −1.38 | −1.38 | −1.46 | −1.47 | −1.71 | −1.91 | −1.75 | −1.59 | −1.82 | −1.86 | 3 | HGG1 |
| 2506973 | −1.82 | −2.19 to −1.42 | −1.88 | −1.96 | −1.66 | −2.19 | −2.06 | −1.42 | −1.77 | −1.87 | −1.53 | 3 | HGG1 |
| 1876456 | −1.52 | −1.74 to −1.21 | −1.74 | −1.62 | −1.42 | −1.56 | −1.52 | −1.21 | −1.63 | −1.63 | −1.35 | 3 | HGG1 |
| 2886955 | −1.70 | −1.85 to −1.55 | −1.79 | −1.67 | −1.55 | −1.77 | −1.60 | −1.59 | −1.83 | −1.85 | −1.66 | 3 | HGG1 |
| 2912637 | −2.18 | −2.46 to −1.89 | −2.46 | −2.40 | −2.10 | −2.35 | −1.91 | −1.89 | −2.06 | −2.34 | −2.14 | 3 | HGG1 |
| 3001212 | −1.80 | −2.40 to −1.43 | −1.84 | −1.73 | −1.50 | −2.10 | −2.40 | −1.43 | −1.77 | −1.86 | −1.56 | 3 | HGG1 |
| 4408943 | −1.76 | −1.99 to −1.57 | −1.60 | −1.64 | −1.57 | −1.81 | −1.93 | −1.64 | −1.75 | −1.94 | −1.99 | 3 | HGG1 |
| 3031022 | −1.91 | −2.12 to −177 | −1.89 | −1.95 | −1.84 | −1.78 | −1.88 | −1.88 | −1.77 | −2.09 | −2.12 | 3 | HGG1 |
| 5047895 | −1.67 | −1.97 to −1.35 | −1.70 | −1.56 | −1.48 | −1.35 | −1.65 | −1.72 | −1.72 | −1.85 | −1.97 | 3 | HGG1 |
| 5541828 | −1.96 | −2.07 to −1.81 | −2.05 | −1.96 | −1.81 | −1.89 | −2.04 | −1.83 | −2.07 | −2.00 | −2.02 | 3 | HGG1 |
| 560115 | −2.04 | −2.47 to −1.81 | −1.88 | −2.22 | −1.81 | −1.89 | −2.47 | −1.93 | −1.88 | −2.33 | −1.95 | 3 | HGG1 |
| 1614014 | −1.01 | −1.45 to −0.53 | −1.19 | −1.08 | −0.58 | −1.32 | −1.45 | −0.53 | −1.16 | −1.13 | −0.63 | 4 | HGG1 |
| 1697719 | −0.81 | −1.51 to 0.00 | 0.00 | 0.00 | 0.00 | −1.43 | −1.51 | −1.08 | −1.14 | −1.18 | −0.97 | 4 | HGG1 |
| 1868738 | −0.82 | −1.36 to 0.00 | −0.88 | −0.78 | 0.00 | −1.22 | −1.36 | −0.57 | −0.87 | −1.03 | −0.71 | 4 | HGG1 |
| 2055857 | −0.81 | −1.40 to −0.16 | −0.40 | −0.84 | −0.74 | −0.39 | −1.38 | −0.97 | −0.16 | −1.40 | −0.98 | 4 | HGG1 |
| 2078880 | −0.80 | −1.34 to 0.00 | −0.70 | 0.00 | 0.00 | −1.23 | −1.34 | −1.03 | −0.86 | −1.14 | −0.92 | 4 | HGG1 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 3497137 | −0.94 | −1.33 to −0.57 | −1.15 | −1.03 | −0.67 | −1.33 | −1.19 | −0.58 | −1.07 | −0.83 | −0.57 | 4 | HGG 1 |
| 3770530 | −0.98 | −1.37 to −0.62 | −1.15 | −1.05 | −0.70 | −1.34 | −1.37 | −0.67 | −1.05 | −0.87 | −0.62 | 4 | HGG 1 |
| 2382190 | −0.77 | −1.50 to 0.00 | 0.00 | 0.00 | 0.00 | −1.12 | −1.50 | −0.97 | −0.94 | −1.23 | −1.16 | 4 | HGG 1 |
| 2239738 | −0.20 | −1.84 to 0.09 | 0.08 | 0.00 | −0.06 | −0.09 | −0.10 | −1.84 | 0.05 | 0.09 | 0.05 | 4 | HGG 1 |
| 4089291 | −1.00 | −1.45 to −0.72 | −1.01 | −0.99 | −0.90 | −1.15 | −1.45 | −0.88 | −0.72 | −0.98 | −0.91 | 4 | HGG 1 |
| 3139631 | −0.97 | −1.47 to −0.55 | −1.20 | −1.11 | −0.88 | −1.23 | −1.47 | −0.74 | −0.76 | −0.78 | −0.55 | 4 | HGG 1 |
| 2131958 | −0.99 | −1.48 to −0.72 | −0.95 | −1.02 | −0.79 | −1.18 | −1.48 | −0.87 | −0.72 | −1.00 | −0.87 | 4 | HGG 1 |
| 2818476 | 2.55 | 2.19 to 2.94 | 2.94 | 2.92 | 2.73 | 2.41 | 2.31 | 2.19 | 2.69 | 2.52 | 2.21 | 5 | HGG 1 |
| 2823767 | 2.05 | 1.84 to 2.29 | 2.29 | 2.19 | 2.09 | 2.02 | 2.06 | 1.92 | 2.16 | 1.89 | 1.84 | 5 | HGG 1 |
| 3792988 | 2.27 | 1.98 to 2.54 | 2.54 | 2.40 | 2.54 | 2.17 | 2.41 | 1.98 | 2.33 | 2.02 | 2.01 | 5 | HGG 1 |
| 3068809 | 2.28 | 1.96 to 2.61 | 2.61 | 2.51 | 2.55 | 2.21 | 2.33 | 2.04 | 2.28 | 1.96 | 2.00 | 5 | HGG 1 |
| 1320685 | 2.03 | 1.87 to 2.21 | 2.08 | 2.07 | 1.91 | 2.12 | 2.01 | 1.87 | 2.21 | 1.96 | 2.03 | 5 | HGG 1 |
| 5501676 | 2.11 | 1.58 to 2.71 | 2.46 | 2.71 | 2.61 | 1.73 | 1.63 | 1.58 | 2.26 | 2.15 | 1.87 | 5 | HGG 1 |
| 1457424 | 2.47 | 2.34 to 2.64 | 2.64 | 2.60 | 2.56 | 2.46 | 2.42 | 2.38 | 2.47 | 2.34 | 2.38 | 5 | HGG 1 |
| 4287327 | 2.49 | 2.31 to 2.76 | 2.35 | 2.41 | 2.43 | 2.37 | 2.76 | 2.31 | 2.56 | 2.68 | 2.58 | 5 | HGG 1 |
| 2956444 | 2.23 | 1.91 to 2.62 | 2.59 | 2.62 | 2.57 | 2.02 | 2.22 | 2.04 | 2.14 | 1.96 | 1.91 | 5 | HGG 1 |
| 617587 | 2.13 | 1.82 to 2.36 | 2.36 | 2.25 | 2.32 | 2.09 | 2.07 | 1.82 | 2.23 | 2.04 | 1.99 | 5 | HGG 1 |
| 2110430 | 2.27 | 1.89 to 2.48 | 2.44 | 2.20 | 2.23 | 2.48 | 2.27 | 1.89 | 2.47 | 2.22 | 2.21 | 5 | HGG 1 |
| 2520894 | 2.32 | 1.99 to 2.58 | 2.58 | 2.49 | 2.57 | 2.18 | 2.34 | 1.99 | 2.40 | 2.17 | 2.17 | 5 | HGG 1 |
| 408442 | 0.35 | 0.00 to 1.59 | 0.00 | 0.00 | 0.00 | 0.50 | 0.19 | 0.42 | 0.00 | 0.41 | 1.59 | 6 | HGG 1 |
| 1513566 | 0.61 | 0.05 to 1.38 | 0.05 | 0.56 | 0.62 | 0.17 | 0.72 | 0.64 | 0.32 | 1.00 | 1.38 | 6 | HGG 1 |
| 1299246 | 0.50 | −0.25 to 1.59 | −0.25 | 0.43 | 0.49 | −0.08 | 0.47 | 0.50 | 0.26 | 1.06 | 1.59 | 6 | HGG 1 |
| 4858420 | 0.47 | −0.18 to 1.49 | −0.18 | 0.38 | 0.43 | −0.12 | 0.53 | 0.51 | 0.25 | 0.98 | 1.49 | 6 | HGG 1 |
| 1308729 | 0.55 | −0.14 to 1.66 | −0.14 | 0.42 | 0.39 | −0.02 | 0.59 | 0.52 | 0.44 | 1.13 | 1.66 | 6 | HGG 1 |
| 5038177 | 0.57 | −0.06 to 1.53 | −0.06 | 0.49 | 0.48 | 0.04 | 0.58 | 0.56 | 0.35 | 1.12 | 1.53 | 6 | HGG 1 |
| 1737512 | 0.24 | 0.00 to 1.32 | 1.32 | 0.00 | 0.01 | 0.22 | 0.10 | 0.12 | 0.00 | 0.14 | 0.23 | 6 | HGG 1 |
| 305751 | 1.04 | 0.00 to 1.76 | 0.00 | 0.00 | 0.00 | 1.76 | 1.49 | 1.43 | 1.71 | 1.47 | 1.52 | 7 | HGG 1 |
| 1447306 | 0.41 | 0.00 to 2.44 | 0.00 | 0.00 | 0.00 | 0.38 | 2.44 | 0.55 | 0.00 | 0.07 | 0.26 | 7 | HGG 1 |
| 2579218 | 0.85 | 0.00 to 1.36 | 0.00 | 0.00 | 1.36 | 1.09 | 1.07 | 0.86 | 1.17 | 1.06 | 1.01 | 7 | HGG 1 |
| 2358261 | 0.62 | 0.00 to 1.60 | 0.00 | 0.00 | 0.00 | 1.60 | 1.35 | 1.15 | 0.00 | 1.49 | 0.00 | 7 | HGG 1 |
| 4630674 | 0.97 | 0.00 to 1.76 | 0.00 | 0.00 | 0.00 | 1.76 | 1.41 | 1.37 | 1.45 | 1.40 | 1.37 | 7 | HGG 1 |
| 3391835 | 0.96 | 0.00 to 1.76 | 0.00 | 0.00 | 0.00 | 1.56 | 1.12 | 1.12 | 1.76 | 1.52 | 1.61 | 7 | HGG 1 |
| 2494284 | 1.41 | 1.03 to 1.76 | 1.14 | 1.03 | 1.03 | 1.76 | 1.72 | 1.31 | 1.69 | 1.46 | 1.59 | 8 | HGG 1 |
| 2120743 | 1.47 | 1.37 to 1.57 | 1.48 | 1.57 | 1.37 | 1.57 | 1.57 | 1.37 | 1.43 | 1.46 | 1.40 | 8 | HGG 1 |
| 2070126 | 1.57 | 1.31 to 1.81 | 1.68 | 1.50 | 1.31 | 1.74 | 1.59 | 1.52 | 1.81 | 1.48 | 1.54 | 8 | HGG 1 |
| 5046235 | 1.33 | 0.89 to 1.70 | 1.09 | 0.89 | 0.90 | 1.70 | 1.67 | 1.39 | 1.64 | 1.24 | 1.43 | 8 | HGG 1 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 1630990 | 2.65 | 2.45 to 2.95 | 2.95 | 2.95 | 2.69 | 2.48 | 2.50 | 2.45 | 2.85 | 2.55 | 2.47 | 9 | HGG 1 |
| 4549259 | 3.31 | 2.92 to 3.58 | 3.58 | 3.53 | 3.41 | 3.39 | 3.10 | 2.92 | 3.44 | 3.20 | 3.22 | 9 | HGG 1 |
| 2755836 | 2.96 | 2.57 to 3.53 | 3.03 | 3.34 | 3.53 | 2.57 | 2.76 | 2.97 | 2.85 | 2.78 | 2.77 | 9 | HGG 1 |
| 2057513 | 1.13 | 0.93 to 1.37 | 1.22 | 1.30 | 1.37 | 0.93 | 1.18 | 1.04 | 1.06 | 0.96 | 1.15 | 0 | HGG 2 |
| 1988540 | 1.65 | 1.40 to 1.94 | 1.94 | 1.91 | 1.68 | 1.70 | 1.50 | 1.46 | 1.80 | 1.47 | 1.40 | 0 | HGG 2 |
| 2499976 | 1.22 | 1.00 to 1.42 | 1.33 | 1.14 | 1.13 | 1.42 | 1.27 | 1.00 | 1.38 | 1.10 | 1.20 | 0 | HGG 2 |
| 2018315 | 1.33 | 0.00 to 1.91 | 0.00 | 0.00 | 1.91 | 1.79 | 1.91 | 1.45 | 1.79 | 1.48 | 1.67 | 0 | HGG 2 |
| 2021989 | 1.26 | 0.95 to 1.58 | 1.29 | 1.50 | 1.37 | 1.40 | 1.58 | 1.07 | 1.14 | 0.95 | 1.07 | 0 | HGG 2 |
| 2057265 | 1.06 | 0.68 to 1.42 | 1.20 | 1.32 | 1.42 | 0.97 | 0.88 | 0.68 | 1.01 | 1.06 | 0.97 | 0 | HGG 2 |
| 1407125 | 1.45 | 1.33 to 1.70 | 1.42 | 1.43 | 1.41 | 1.70 | 1.52 | 1.33 | 1.46 | 1.38 | 1.41 | 0 | HGG 2 |
| 2234266 | 1.88 | 0.00 to 2.65 | 0.00 | 0.00 | 2.65 | 2.59 | 2.40 | 2.31 | 2.43 | 2.17 | 2.37 | 0 | HGG 2 |
| 1559844 | 1.40 | 1.17 to 1.58 | 1.53 | 1.49 | 1.38 | 1.58 | 1.45 | 1.36 | 1.35 | 1.17 | 1.26 | 0 | HGG 2 |
| 3206352 | 1.81 | 1.44 to 2.14 | 2.14 | 1.84 | 1.93 | 1.71 | 1.72 | 1.44 | 1.97 | 1.72 | 1.80 | 0 | HGG 2 |
| 626471 | 1.52 | 0.00 to 249 | 0.00 | 0.00 | 2.49 | 1.88 | 2.26 | 1.82 | 1.91 | 1.69 | 1.63 | 0 | HGG 2 |
| 755223 | 1.34 | 1.13 to 1.55 | 1.47 | 1.46 | 1.55 | 1.24 | 1.35 | 1.13 | 1.39 | 1.18 | 1.28 | 0 | HGG 2 |
| 2173973 | 1.08 | 0.71 to 1.68 | 1.44 | 1.68 | 1.50 | 0.79 | 1.07 | 0.96 | 0.84 | 0.71 | 0.72 | 0 | HGG 2 |
| 1679595 | 1.10 | 0.96 to 1.32 | 1.11 | 0.95 | 1.00 | 1.32 | 1.15 | 0.97 | 1.30 | 0.97 | 1.15 | 0 | HGG 2 |
| 1709709 | 1.38 | 1.17 to 1.53 | 1.52 | 1.38 | 1.42 | 1.42 | 1.41 | 1.17 | 1.53 | 1.29 | 1.32 | 0 | HGG 2 |
| 757514 | 1.09 | 0.82 to 1.33 | 1.33 | 1.25 | 1.28 | 1.00 | 1.13 | 0.82 | 1.13 | 0.87 | 0.98 | 0 | HGG 2 |
| 835756 | 0.94 | 0.66 to 1.41 | 1.19 | 1.41 | 1.20 | 0.93 | 0.84 | 0.66 | 0.83 | 0.66 | 0.76 | 0 | HGG 2 |
| 870396 | 1.10 | 0.84 to 1.37 | 1.17 | 1.15 | 1.32 | 1.13 | 1.37 | 0.99 | 1.00 | 0.84 | 0.93 | 0 | HGG 2 |
| 960604 | 1.73 | 1.39 to 2.14 | 2.12 | 2.14 | 2.08 | 1.52 | 1.66 | 1.64 | 1.57 | 1.43 | 1.39 | 0 | HGG 2 |
| 1911819 | 1.17 | 1.01 to 1.38 | 1.38 | 1.29 | 1.19 | 1.06 | 1.28 | 1.01 | 1.16 | 1.06 | 1.11 | 0 | HGG 2 |
| 2230608 | 1.32 | 1.12 to 1.54 | 1.54 | 1.41 | 1.52 | 1.22 | 1.40 | 1.12 | 1.30 | 1.13 | 1.27 | 0 | HGG 2 |
| 1961617 | 1.63 | 0.00 to 2.47 | 2.47 | 0.00 | 0.00 | 2.15 | 2.19 | 1.88 | 2.17 | 1.97 | 1.81 | 0 | HGG 2 |
| 1305249 | −0.98 | −1.37 to −0.82 | −0.82 | −0.82 | −0.86 | −0.99 | −1.21 | −0.91 | −0.85 | −1.37 | −1.00 | 1 | HGG 2 |
| 2453558 | −1.38 | −1.60 to −1.20 | −1.35 | −1.20 | −1.24 | −1.34 | −1.40 | −1.44 | −1.43 | −1.60 | −1.45 | 1 | HGG 2 |
| 3421730 | −0.95 | −1.39 to −0.52 | −0.66 | −0.93 | −1.28 | −0.65 | −0.65 | −1.39 | −0.52 | −1.26 | −1.25 | 1 | HGG 2 |
| 523797 | −1.05 | −1.49 to −0.61 | −0.61 | −0.68 | −0.75 | −1.19 | −1.49 | −1.31 | −0.85 | −1.28 | −1.25 | 1 | HGG 2 |
| 1973123 | −1.23 | −1.86 to 0.00 | −1.34 | 0.00 | −1.13 | −1.49 | −1.86 | −1.13 | −1.37 | −1.64 | −1.11 | 1 | HGG 2 |
| 2529162 | −0.96 | −1.35 to −0.69 | −0.89 | −0.69 | −0.83 | −1.04 | −1.35 | −1.09 | −0.98 | −0.96 | −0.83 | 1 | HGG 2 |
| 2703122 | −1.61 | −1.86 to −1.30 | −1.39 | −1.30 | −1.51 | −1.76 | −1.86 | −1.59 | −1.53 | −1.76 | −1.76 | 1 | HGG 2 |
| 2794866 | −1.33 | −1.85 to 0.00 | 0.00 | −1.06 | −1.51 | −1.52 | −1.85 | −1.38 | −1.44 | −1.67 | −1.53 | 1 | HGG 2 |
| 2253868 | −1.20 | −1.65 to −0.75 | −1.38 | −1.20 | −0.88 | −1.47 | −1.65 | −0.99 | −1.25 | −1.26 | −0.75 | 1 | HGG 2 |
| 3029474 | −0.99 | −1.45 to −0.75 | −0.76 | −0.75 | −0.88 | −1.09 | −1.45 | −1.06 | −0.95 | −1.04 | −0.96 | 1 | HGG 2 |
| 1823946 | −1.10 | −1.33 to −0.95 | −1.04 | −0.95 | −1.16 | −0.99 | −1.14 | −1.15 | −0.96 | −1.33 | −1.23 | 1 | HGG 2 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 3100048 | −0.88 | −1.64 to 0.08 | −0.27 | −1.06 | −1.29 | −0.35 | −0.75 | −1.18 | 0.08 | −1.64 | −1.50 | 1 | HGG 2 |
| 1988774 | −1.18 | −1.82 to −0.42 | −0.78 | −1.43 | −1.16 | −0.64 | −1.59 | −1.57 | −0.42 | −1.82 | −1.24 | 1 | HGG 2 |
| 2293494 | −0.69 | −1.35 to 0.00 | 0.00 | 0.00 | 0.00 | −0.91 | −0.93 | −1.07 | −1.03 | −1.35 | −0.93 | 2 | HGG 2 |
| 1401312 | −1.09 | −2.08 to 0.00 | 0.00 | 0.00 | −0.76 | −1.58 | −2.08 | −1.38 | −1.38 | −1.44 | −1.17 | 2 | HGG 2 |
| 1604650 | −0.70 | −1.51 to 0.00 | 0.00 | 0.00 | 0.00 | 0.00 | −1.14 | −1.51 | −1.23 | −1.46 | −0.98 | 2 | HGG 2 |
| 1616048 | −0.87 | −1.36 to 0.00 | 0.00 | 0.00 | −0.85 | −1.00 | −1.25 | −1.28 | −0.86 | −1.36 | −1.26 | 2 | HGG 2 |
| 1662870 | −0.93 | −1.59 to 0.00 | 0.00 | 0.00 | 0.00 | −1.30 | −1.44 | −1.40 | −1.46 | −1.59 | −1.17 | 2 | HGG 2 |
| 1753283 | −1.24 | −1.96 to 0.00 | 0.00 | −1.04 | 0.00 | −1.81 | −1.96 | −1.63 | −1.59 | −1.68 | −1.45 | 2 | HGG 2 |
| 2703282 | −1.01 | −1.59 to 0.00 | 0.00 | 0.00 | −1.12 | −1.27 | −1.59 | −1.22 | −1.19 | −1.43 | −1.24 | 2 | HGG 2 |
| 2706669 | −0.87 | −1.76 to 0.00 | 0.00 | 0.00 | −0.71 | −1.11 | −1.76 | −1.10 | −0.94 | −1.44 | −0.78 | 2 | HGG 2 |
| 1799078 | −0.70 | −1.40 to 0.00 | 0.00 | 0.00 | 0.00 | −0.86 | −1.01 | −1.39 | −0.66 | −1.02 | −1.40 | 2 | HGG 2 |
| 3426776 | 0.61 | 0.00 to 1.33 | 0.00 | 0.00 | 0.00 | 0.00 | 1.33 | 0.83 | 1.21 | 1.00 | 1.15 | 3 | HGG 2 |
| 1926934 | 0.72 | 0.00 to 1.71 | 0.00 | 0.00 | 0.00 | 0.00 | 1.68 | 1.55 | 1.71 | 1.54 | 0.00 | 3 | HGG 2 |
| 2725369 | 0.87 | 0.26 to 1.48 | 0.38 | 0.29 | 0.26 | 1.48 | 1.07 | 0.58 | 1.43 | 1.05 | 1.27 | 3 | HGG 2 |
| 2226309 | 0.71 | 0.00 to 1.63 | 0.00 | 0.00 | 0.00 | 0.00 | 1.63 | 1.35 | 1.19 | 1.11 | 1.10 | 3 | HGG 2 |
| 2222155 | 0.58 | 0.00 to 1.59 | 0.00 | 0.00 | 0.00 | 0.00 | 1.59 | 0.86 | 0.86 | 0.89 | 0.99 | 3 | HGG 2 |
| 1303862 | 1.28 | 0.00 to 2.64 | 0.00 | 0.00 | 0.00 | 0.00 | 2.20 | 1.81 | 2.33 | 2.64 | 2.57 | 3 | HGG 2 |
| 1515346 | 0.87 | 0.00 to 1.51 | 0.00 | 0.00 | 0.00 | 1.35 | 1.40 | 1.13 | 1.51 | 1.22 | 1.21 | 3 | HGG 2 |
| 1670407 | 0.67 | 0.00 to 1.42 | 0.00 | 0.00 | 0.00 | 1.29 | 1.42 | 0.95 | 0.00 | 1.22 | 1.20 | 3 | HGG 2 |
| 2246915 | 0.39 | 0.00 to 194 | 0.00 | 0.00 | 0.00 | 0.00 | 1.94 | 1.53 | 0.00 | 0.00 | 0.00 | 4 | HGG 2 |
| 686993 | 0.51 | 0.00 to 1.80 | 0.00 | 0.00 | 0.00 | 0.00 | 1.80 | 1.26 | 0.00 | 1.50 | 0.00 | 4 | HGG 2 |
| 3229449 | 0.39 | 0.00 to 1.49 | 0.00 | 0.00 | 0.00 | 0.00 | 1.17 | 0.89 | 0.00 | 1.49 | 0.00 | 4 | HGG 2 |
| 2760615 | 0.23 | 0.00 to 1.46 | 0.00 | 0.00 | 0.00 | 0.00 | 1.46 | 0.62 | 0.00 | 0.00 | 0.00 | 4 | HGG 2 |
| 868678 | 0.39 | 0.00 to 1.58 | 0.00 | 0.00 | 0.00 | 0.00 | 1.58 | 0.81 | 0.00 | 1.08 | 0.00 | 4 | HGG 2 |
| 2837006 | 0.37 | 0.00 to 1.88 | 0.00 | 0.00 | 0.00 | 0.00 | 1.88 | 1.46 | 0.00 | 0.00 | 0.00 | 4 | HGG 2 |
| 1316801 | 2.58 | 2.28 to 2.90 | 2.69 | 2.63 | 2.65 | 2.67 | 2.90 | 2.37 | 2.68 | 2.28 | 2.35 | 5 | HGG 2 |
| 660142 | 2.99 | 2.61 to 3.34 | 3.01 | 2.99 | 3.31 | 3.14 | 3.34 | 2.85 | 2.94 | 2.72 | 2.61 | 5 | HGG 2 |
| 2544622 | 2.51 | 0.00 to 3.33 | 3.33 | 0.00 | 3.26 | 2.82 | 2.59 | 2.58 | 2.77 | 2.65 | 2.57 | 5 | HGG 2 |
| 1326255 | 2.78 | 2.39 to 3.06 | 3.05 | 3.06 | 2.90 | 2.87 | 2.39 | 2.55 | 2.85 | 2.64 | 2.67 | 5 | HGG 2 |
| 2124056 | 2.61 | 2.39 to 2.92 | 2.53 | 2.41 | 2.47 | 2.92 | 2.83 | 2.68 | 2.67 | 2.39 | 2.64 | 5 | HGG 2 |
| 2215282 | 0.55 | 0.00 to 1.60 | 0.00 | 0.56 | 0.53 | 0.51 | 0.49 | 0.32 | 1.60 | 0.48 | 0.44 | 6 | HGG 2 |
| 1798594 | 0.69 | 0.23 to 1.35 | 1.35 | 1.34 | 1.23 | 0.29 | 0.58 | 0.42 | 0.48 | 0.23 | 0.28 | 6 | HGG 2 |
| 2189061 | 0.15 | 0.00 to 1.32 | 0.00 | 0.00 | 0.00 | 0.00 | 0.00 | 1.32 | 0.00 | 0.00 | 0.00 | 6 | HGG 2 |
| 1317428 | 0.19 | −0.18 to 1.49 | 0.00 | 0.00 | 0.00 | 0.00 | 0.17 | −0.18 | 0.18 | 0.03 | 1.49 | 6 | HGG 2 |
| 1251065 | 1.38 | 1.05 to 1.62 | 1.53 | 1.62 | 1.55 | 1.46 | 1.40 | 1.05 | 1.53 | 1.18 | 1.12 | 0 | HGG 3 |
| 4252872 | 1.24 | 0.96 to 1.52 | 1.31 | 1.27 | 1.29 | 1.52 | 1.38 | 1.04 | 1.40 | 0.97 | 0.96 | 0 | HGG 3 |

TABLE 10-continued

| Clone ID | Ave DE t/Bude | Range | mean DE t/Bude 1 µM, 1 hr | mean DE t/Bude 1 µM, 3 hr | mean DE t/Bude 1 µM, 6 hr | mean DE t/Bude 10 µM, 1 hr | mean DE t/Bude 10 µM, 3 hr | mean DE t/Bude 10 µM, 6 hr | mean DE t/Bude 100 µM, 1 hr | mean DE t/Bude 100 µM, 3 hr | mean DE t/Bude 100 µM, 6 hr | Cluster | GEM |
|---|---|---|---|---|---|---|---|---|---|---|---|---|---|
| 4855265 | 1.14 | 0.81 to 1.43 | 1.29 | 1.43 | 1.35 | 1.26 | 1.12 | 0.91 | 1.17 | 0.81 | 0.95 | 0 | HGG 3 |
| 4863677 | 1.11 | 0.81 to 1.35 | 1.20 | 1.35 | 1.24 | 1.21 | 1.14 | 0.81 | 1.12 | 0.97 | 0.99 | 0 | HGG 3 |
| 4912315 | 1.60 | 1.36 to 1.92 | 1.89 | 1.92 | 1.82 | 1.65 | 1.43 | 1.36 | 1.58 | 1.38 | 1.40 | 0 | HGG 3 |
| 2170820 | 1.17 | 1.01 to 1.38 | 1.28 | 1.26 | 1.38 | 1.22 | 1.13 | 1.04 | 1.15 | 1.01 | 1.09 | 0 | HGG 3 |
| 5322365 | 1.49 | 1.23 to 1.73 | 1.58 | 1.73 | 1.69 | 1.52 | 1.47 | 1.23 | 1.56 | 1.26 | 1.41 | 0 | HGG 3 |
| 554654 | 0.99 | 0.67 to 1.34 | 1.34 | 1.19 | 0.91 | 0.94 | 0.67 | 0.70 | 1.02 | 1.15 | 1.03 | 0 | HGG 3 |
| 2343836 | 0.93 | 0.65 to 1.36 | 0.65 | 1.29 | 1.36 | 0.75 | 0.69 | 0.95 | 1.05 | 0.78 | 0.86 | 0 | HGG 3 |
| 615776 | 1.06 | 0.68 to 1.48 | 1.35 | 1.48 | 1.47 | 1.04 | 0.91 | 0.80 | 1.01 | 0.68 | 0.81 | 0 | HGG 3 |
| 689296 | 1.05 | 0.84 to 1.33 | 1.14 | 1.28 | 1.33 | 0.89 | 0.91 | 0.84 | 0.91 | 1.03 | 1.10 | 0 | HGG 3 |
| 2545486 | 1.46 | 1.06 to 1.74 | 1.67 | 1.51 | 1.72 | 1.74 | 1.23 | 1.33 | 1.51 | 1.06 | 1.35 | 0 | HGG 3 |
| 3332232 | 1.08 | 0.81 to 1.38 | 1.38 | 1.20 | 1.03 | 1.16 | 1.06 | 0.84 | 1.21 | 0.81 | 1.02 | 0 | HGG 3 |
| 2660756 | 1.13 | 0.84 to 1.75 | 1.12 | 1.75 | 1.25 | 1.20 | 1.19 | 0.88 | 1.03 | 0.84 | 0.92 | 0 | HGG 3 |
| 2687356 | 1.26 | 0.93 to 1.47 | 1.47 | 1.45 | 1.36 | 1.43 | 1.33 | 1.07 | 1.24 | 0.93 | 1.06 | 0 | HGG 3 |
| 3495173 | 1.52 | 1.18 to 1.69 | 1.66 | 1.69 | 1.66 | 1.67 | 1.63 | 1.42 | 1.43 | 1.18 | 1.30 | 0 | HGG 3 |
| 748477 | 1.42 | 1.12 to 1.63 | 1.59 | 1.63 | 1.41 | 1.38 | 1.32 | 1.12 | 1.34 | 1.39 | 1.57 | 0 | HGG 3 |
| 2871076 | 1.30 | 0.92 to 1.63 | 1.40 | 1.60 | 1.63 | 1.36 | 1.10 | 0.92 | 1.40 | 1.07 | 1.19 | 0 | HGG 3 |
| 2972013 | 1.49 | 1.14 to 1.74 | 1.60 | 1.74 | 1.66 | 1.59 | 1.45 | 1.40 | 1.55 | 1.14 | 1.31 | 0 | HGG 3 |
| 3034889 | 1.51 | 1.26 to 1.75 | 1.56 | 1.75 | 1.65 | 1.55 | 1.51 | 1.26 | 1.61 | 1.31 | 1.37 | 0 | HGG 3 |
| 3974247 | 1.47 | 1.17 to 1.78 | 1.66 | 1.78 | 1.77 | 1.42 | 1.44 | 1.19 | 1.59 | 1.17 | 1.18 | 0 | HGG 3 |
| 3973687 | 1.31 | 1.01 to 1.52 | 1.37 | 1.52 | 1.49 | 1.37 | 1.46 | 1.18 | 1.34 | 1.01 | 1.06 | 0 | HGG 3 |
| 4215034 | 1.20 | 0.83 to 1.45 | 1.44 | 1.34 | 1.45 | 1.18 | 1.26 | 0.83 | 1.19 | 1.02 | 1.07 | 0 | HGG 3 |
| 3090808 | −1.14 | −1.75 to 0.00 | 0.00 | −0.97 | −0.85 | −1.55 | −1.75 | −1.25 | −1.18 | −1.53 | −1.18 | 1 | HGG 3 |
| 5089438 | −1.09 | −1.44 to −0.44 | −1.07 | −1.06 | −0.79 | −1.44 | −1.28 | −1.43 | −0.44 | −1.06 | −1.25 | 1 | HGG 3 |
| 1911443 | −0.98 | −1.56 to −0.42 | −0.42 | −0.73 | −1.36 | −0.63 | −0.80 | −1.56 | −0.56 | −1.43 | −1.38 | 1 | HGG 3 |
| 3097624 | −1.19 | −1.33 to −1.03 | −1.15 | −1.20 | −1.20 | −1.20 | −1.03 | −1.33 | −1.20 | −1.30 | −1.05 | 1 | HGG 3 |
| 3120209 | −1.45 | −2.05 to −0.91 | −2.05 | −1.47 | −0.91 | −2.01 | −1.29 | −0.98 | −1.94 | −1.40 | −0.96 | 1 | HGG 3 |
| 3135460 | −1.36 | −1.97 to −0.81 | −0.94 | −1.17 | −1.46 | −1.11 | −1.43 | −1.82 | −0.81 | −1.51 | −1.97 | 1 | HGG 3 |
| 3778404 | −1.77 | −2.06 to −1.34 | −1.34 | −1.81 | −1.63 | −1.85 | −1.97 | −1.92 | −1.49 | −1.90 | −2.00 | 1 | HGG 3 |
| 4715924 | −1.35 | −1.81 to −0.92 | −1.50 | −1.42 | −1.06 | −1.55 | −1.81 | −1.14 | −1.36 | −1.40 | −0.92 | 1 | HGG 3 |
| 654246 | −1.08 | −1.34 to −0.65 | −0.65 | −1.02 | −0.98 | −1.15 | −1.28 | −1.33 | −0.78 | −1.20 | −1.34 | 1 | HGG 3 |
| 5573549 | −1.49 | −1.59 to −1.42 | −1.46 | −1.52 | −1.49 | −1.48 | −1.42 | −1.54 | −1.59 | −1.46 | −1.48 | 1 | HGG 3 |
| 4289557 | −2.09 | −2.41 to −1.71 | −1.71 | −1.87 | −1.88 | −2.26 | −2.33 | −2.41 | −1.96 | −2.10 | −2.27 | 1 | HGG 3 |
| 5427710 | −1.96 | −2.07 to −1.80 | −1.80 | −2.07 | −1.92 | −1.99 | −1.86 | −2.06 | −1.89 | −2.03 | −2.05 | 1 | HGG 3 |
| 5166479 | −1.43 | −1.71 to −1.02 | −1.27 | −1.68 | −1.71 | −1.12 | −1.54 | −1.58 | −1.02 | −1.65 | −1.26 | 1 | HGG 3 |
| 5044351 | −0.88 | −1.44 to 0.00 | 0.00 | −0.91 | −0.64 | −0.97 | −1.44 | −0.99 | −0.70 | −1.43 | −0.85 | 1 | HGG 3 |
| 3084204 | −1.56 | −1.80 to −1.40 | −1.40 | −1.46 | −1.49 | −1.80 | −1.60 | −1.64 | −1.41 | −1.55 | −1.70 | 1 | HGG 3 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 5508135 | 1.66 | 0.00 to 2.20 | 0.00 | 2.20 | 2.11 | 2.09 | 1.79 | 1.48 | 2.13 | 1.64 | 1.55 | 2 | HGG 3 |
| 1786554 | 1.64 | 1.34 to 2.03 | 1.94 | 2.03 | 1.80 | 1.68 | 1.55 | 1.34 | 1.58 | 1.38 | 1.45 | 2 | HGG 3 |
| 5512044 | 1.91 | 1.62 to 2.20 | 1.92 | 2.09 | 2.20 | 2.09 | 1.91 | 1.65 | 1.92 | 1.62 | 1.81 | 2 | HGG 3 |
| 4402555 | 2.38 | 1.95 to 2.61 | 2.49 | 2.61 | 2.56 | 2.60 | 2.39 | 2.15 | 2.30 | 1.95 | 2.33 | 2 | HGG 3 |
| 2343348 | 1.92 | 1.76 to 2.21 | 1.85 | 2.10 | 2.21 | 1.91 | 1.92 | 1.90 | 1.88 | 1.79 | 1.76 | 2 | HGG 3 |
| 621543 | 1.87 | 1.47 to 2.25 | 2.03 | 2.25 | 2.06 | 1.98 | 1.78 | 1.47 | 1.87 | 1.69 | 1.72 | 2 | HGG 3 |
| 3074113 | 2.17 | 1.89 to 2.55 | 2.15 | 255 | 2.40 | 2.23 | 2.15 | 2.02 | 2.16 | 1.89 | 1.99 | 2 | HGG 3 |
| 3158828 | 1.97 | 1.53 to 2.34 | 2.26 | 2.33 | 2.34 | 2.14 | 1.99 | 1.71 | 1.84 | 1.53 | 1.56 | 2 | HGG 3 |
| 3957354 | 1.89 | 0.00 to 291 | 0.00 | 2.91 | 2.79 | 2.21 | 2.29 | 2.38 | 0.00 | 2.22 | 2.20 | 2 | HGG 3 |
| 5102731 | 1.86 | 1.66 to 2.19 | 1.94 | 2.19 | 1.98 | 1.66 | 2.00 | 1.68 | 1.82 | 1.68 | 1.80 | 2 | HGG 3 |
| 4253809 | 1.98 | 1.81 to 2.17 | 1.94 | 2.04 | 1.97 | 2.17 | 2.02 | 1.81 | 2.05 | 1.87 | 1.95 | 2 | HGG 3 |
| 3091135 | 0.01 | −0.37 to 1.52 | 1.52 | 0.11 | 0.09 | −0.15 | −0.33 | −0.36 | −0.20 | −0.37 | −0.26 | 3 | HGG 3 |
| 4232507 | 0.50 | 0.00 to 1.43 | 0.00 | 0.00 | 0.00 | 1.43 | 0.00 | 1.09 | 0.00 | 0.84 | 1.15 | 3 | HGG 3 |
| 2195427 | 0.15 | 0.00 to 1.34 | 0.00 | 0.00 | 0.00 | 0.00 | 0.00 | 1.34 | 0.0a | 0.00 | 0.00 | 3 | HGG 3 |
| 2399169 | 0.21 | −0.11 to 2.01 | 2.01 | 0.00 | 0.00 | 0.00 | −0.03 | −0.11 | 0.00 | 0.04 | 0.00 | 3 | HGG 3 |
| 2611889 | 0.15 | 0.00 to 1.33 | 0.00 | 0.00 | 0.00 | 0.00 | 0.00 | 0.00 | 0.00 | 0.00 | 1.33 | 3 | HGG 3 |
| 699113 | 0.20 | 0.00 to 1.78 | 0.00 | 0.00 | 0.00 | 0.00 | 0.00 | 1.78 | 0.00 | 0.00 | 0.00 | 3 | HGG 3 |
| 3979665 | −0.04 | −2.67 to 0.60 | 0.00 | −2.67 | 0.27 | 0.00 | 0.60 | 0.36 | 0.59 | 0.48 | 0.00 | 3 | HGG 3 |
| 2539933 | −0.16 | −1.76 to 0.16 | 0.00 | 0.00 | 0.00 | 0.00 | 0.14 | 0.03 | −1.76 | 0.16 | 0.00 | 3 | HGG 3 |
| 3068978 | 0.19 | 0.00 to 1.67 | 0.00 | 0.00 | 0.00 | 0.00 | 0.00 | 1.67 | 0.00 | 0.00 | 0.00 | 3 | HGG 3 |
| 2726759 | −0.02 | −0.39 to 1.47 | 1.47 | 0.00 | 0.09 | −0.22 | −0.38 | −0.37 | −0.26 | −0.39 | −0.08 | 3 | HGG 3 |
| 1560380 | 0.68 | 0.00 to 1.59 | 0.00 | 0.00 | 0.00 | 0.00 | 1.59 | 1.49 | 0.00 | 1.52 | 1.52 | 4 | HGG 3 |
| 664625 | 0.83 | 0.00 to 1.79 | 0.00 | 0.00 | 0.00 | 0.00 | 1.45 | 1.24 | 1.79 | 1.48 | 1.53 | 4 | HGG 3 |
| 517374 | 1.04 | 0.00 to 1.69 | 0.00 | 0.00 | 1.69 | 1.41 | 1.42 | 1.16 | 1.42 | 1.16 | 1.13 | 4 | HGG 3 |
| 5326983 | 0.94 | 0.00 to 1.61 | 0.00 | 0.00 | 1.61 | 1.30 | 1.28 | 0.92 | 1.26 | 1.01 | 1.06 | 4 | HGG 3 |
| 4508879 | 0.91 | 0.00 to 1.51 | 0.00 | 0.00 | 1.48 | 0.00 | 1.31 | 1.20 | 1.20 | 1.51 | 1.50 | 4 | HGG 3 |
| 621216 | 0.79 | 0.00 to 1.40 | 0.00 | 0.00 | 1.40 | 1.01 | 0.99 | 0.86 | 1.14 | 0.85 | 0.85 | 4 | HGG 3 |
| 872017 | 1.26 | 0.00 to 2.00 | 0.00 | 0.00 | 2.00 | 1.75 | 1.66 | 1.53 | 1.53 | 1.35 | 1.52 | 4 | HGG 3 |
| 3172265 | 3.11 | 2.90 to 3.39 | 3.01 | 3.18 | 3.39 | 3.07 | 3.23 | 3.11 | 3.04 | 2.90 | 3.02 | 5 | HGG 3 |
| 3069190 | 3.87 | 3.57 to 4.20 | 3.82 | 3.86 | 3.76 | 4.20 | 4.01 | 3.76 | 4.01 | 3.57 | 3.86 | 5 | HGG 3 |
| 5266015 | 2.58 | 2.24 to 2.77 | 2.65 | 2.77 | 2.70 | 2.73 | 2.68 | 2.29 | 2.62 | 2.24 | 2.50 | 5 | HGG 3 |
| 2702786 | 0.19 | −0.19 to 2.06 | −0.07 | −0.12 | −0.18 | −0.18 | −0.19 | −0.18 | 2.06 | 0.29 | 0.25 | 6 | HGG 3 |
| 2169433 | 0.29 | 0.00 to 2.50 | 0.00 | 0.00 | 0.00 | 0.00 | 0.00 | 0.10 | 2.50 | 0.00 | 0.00 | 6 | HGG 3 |
| 439415 | 1.23 | 1.01 to 1.53 | 1.36 | 1.53 | 1.41 | 1.25 | 1.20 | 1.14 | 1.07 | 1.01 | 1.09 | 0 | HGG 4 |
| 1942785 | 0.85 | 0.47 to 1.32 | 1.32 | 0.89 | 0.70 | 0.82 | 1.06 | 0.70 | 0.74 | 0.47 | 0.91 | 0 | HGG 4 |
| 2751922 | 1.28 | 0.97 to 1.56 | 1.56 | 1.18 | 1.26 | 1.25 | 1.34 | 1.14 | 1.33 | 0.97 | 1.46 | 0 | HGG 4 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 2062085 | 1.30 | 1.11 to 1.47 | 1.32 | 1.47 | 1.41 | 1.44 | 1.27 | 1.16 | 1.31 | 1.11 | 1.20 | 0 | HGG4 |
| 409209 | 1.18 | 1.03 to 1.44 | 1.26 | 1.18 | 1.04 | 1.31 | 1.44 | 1.06 | 1.24 | 1.08 | 1.03 | 0 | HGG4 |
| 1448572 | 1.29 | 1.06 to 1.71 | 1.71 | 1.26 | 1.26 | 1.09 | 1.41 | 1.06 | 1.30 | 1.06 | 1.42 | 0 | HGG4 |
| 5101167 | 1.29 | 0.00 to 1.80 | 1.80 | 1.58 | 1.37 | 1.51 | 1.62 | 1.36 | 0.00 | 1.06 | 1.29 | 0 | HGG4 |
| 5102951 | 0.84 | 0.00 to 1.54 | 1.54 | 0.00 | 1.12 | 1.16 | 0.00 | 0.92 | 1.07 | 0.72 | 1.02 | 0 | HGG4 |
| 3449615 | 1.05 | 0.59 to 1.65 | 1.65 | 1.13 | 1.05 | 0.92 | 1.23 | 0.82 | 1.03 | 0.59 | 1.04 | 0 | HGG4 |
| 1611629 | 1.19 | 0.84 to 1.53 | 1.37 | 1.19 | 1.35 | 1.29 | 1.53 | 1.02 | 0.99 | 0.84 | 1.09 | 0 | HGG4 |
| 5507406 | 0.95 | 0.00 to 1.53 | 1.53 | 0.00 | 1.08 | 0.85 | 1.06 | 0.91 | 1.08 | 0.85 | 1.17 | 0 | HGG4 |
| 3016137 | 1.41 | 0.93 to 1.79 | 1.34 | 1.79 | 0.93 | 1.72 | 1.06 | 1.28 | 1.46 | 1.51 | 1.61 | 0 | HGG4 |
| 1716458 | 1.24 | 1.00 to 1.42 | 1.37 | 1.42 | 1.36 | 1.31 | 1.25 | 1.01 | 1.26 | 1.00 | 1.22 | 0 | HGG4 |
| 2158661 | 0.91 | 0.50 to 1.38 | 1.38 | 0.95 | 0.84 | 0.86 | 1.03 | 0.96 | 0.70 | 0.50 | 0.97 | 0 | HGG4 |
| 1730026 | 1.31 | 0.87 to 1.57 | 1.57 | 1.36 | 1.56 | 1.35 | 1.51 | 1.04 | 1.22 | 0.87 | 1.33 | 0 | HGG4 |
| 2196870 | 1.19 | 0.99 to 1.40 | 1.30 | 1.40 | 1.10 | 1.27 | 1.26 | 1.24 | 0.99 | 1.02 | 1.17 | 0 | HGG4 |
| 2227273 | 1.05 | 0.59 to 1.58 | 0.69 | 0.81 | 0.59 | 1.58 | 1.23 | 0.98 | 1.18 | 1.03 | 1.34 | 0 | HGG4 |
| 2756587 | 1.22 | 0.96 to 1.45 | 1.24 | 1.30 | 1.45 | 1.40 | 1.22 | 1.05 | 1.21 | 0.96 | 1.19 | 0 | HGG4 |
| 1365045 | 2.17 | 1.86 to 2.40 | 2.39 | 2.22 | 2.18 | 2.18 | 2.40 | 1.86 | 2.24 | 1.99 | 2.12 | 1 | HGG4 |
| 434751 | 1.75 | 1.50 to 2.03 | 1.66 | 1.78 | 1.50 | 2.03 | 1.88 | 1.69 | 1.85 | 1.65 | 1.76 | 1 | HGG4 |
| 2106010 | 1.72 | 1.43 to 1.97 | 1.89 | 1.64 | 1.92 | 1.82 | 1.97 | 1.57 | 1.61 | 1.43 | 1.66 | 1 | HGG4 |
| 2110482 | 1.48 | 1.27 to 1.79 | 1.60 | 1.61 | 1.79 | 1.49 | 1.57 | 1.27 | 1.32 | 1.30 | 1.39 | 1 | HGG4 |
| 4077648 | 1.47 | 0.99 to 1.79 | 1.63 | 1.39 | 0.99 | 1.79 | 1.66 | 1.41 | 1.56 | 1.22 | 1.54 | 1 | HGG4 |
| 3191030 | 1.97 | 1.73 to 2.19 | 2.08 | 2.00 | 1.76 | 1.98 | 2.10 | 1.73 | 2.19 | 1.87 | 2.01 | 1 | HGG4 |
| 2007730 | 1.67 | 1.24 to 2.09 | 2.09 | 1.84 | 1.64 | 1.67 | 1.95 | 1.56 | 1.49 | 1.24 | 1.54 | 1 | HGG4 |
| 2619275 | 1.62 | 1.31 to 1.92 | 1.92 | 1.74 | 1.64 | 1.67 | 1.85 | 1.44 | 1.49 | 1.31 | 1.56 | 1 | HGG4 |
| 2350594 | 1.49 | 1.22 to 1.67 | 1.63 | 1.51 | 1.67 | 1.52 | 1.65 | 1.22 | 1.26 | 1.41 | 1.53 | 1 | HGG4 |
| 2408333 | 1.53 | 0.00 to 2.04 | 1.42 | 0.00 | 1.41 | 1.80 | 1.00 | 1.54 | 1.91 | 1.74 | 2.04 | 1 | HGG4 |
| 1913334 | 1.66 | 1.34 to 1.79 | 1.79 | 1.79 | 1.77 | 1.65 | 1.71 | 1.43 | 1.74 | 1.34 | 1.71 | 1 | HGG4 |
| 1965856 | 1.56 | 1.23 to 1.69 | 1.53 | 1.68 | 1.65 | 1.64 | 1.58 | 1.23 | 1.69 | 1.53 | 1.55 | 1 | HGG4 |
| 2006043 | 1.41 | 0.00 to 177 | 1.77 | 0.00 | 1.60 | 1.68 | 1.75 | 1.40 | 1.66 | 1.36 | 1.49 | 1 | HGG4 |
| 5690026 | 1.57 | 1.30 to 1.89 | 1.62 | 1.57 | 1.70 | 1.72 | 1.89 | 1.32 | 1.48 | 1.30 | 1.53 | 1 | HGG4 |
| 1876829 | −1.13 | −1.44 to −0.88 | −1.14 | −1.03 | −0.88 | −1.18 | −1.22 | −1.44 | −1.19 | −1.11 | −1.02 | 2 | HGG4 |
| 1953051 | −1.16 | −1.42 to −0.94 | −1.42 | −1.38 | −1.34 | −0.95 | −1.11 | −1.12 | −1.04 | −1.11 | −0.94 | 2 | HGG4 |
| 2055569 | −1.00 | −1.75 to −0.20 | −0.55 | −1.14 | −1.48 | −0.69 | −0.38 | −1.54 | −0.20 | −1.24 | −1.75 | 2 | HGG4 |
| 2346851 | −0.97 | −1.33 to −0.76 | −0.76 | −0.86 | −0.82 | −1.04 | −1.33 | −1.02 | −0.96 | −1.06 | −0.86 | 2 | HGG4 |
| 2747179 | −0.99 | −1.41 to −0.65 | −1.03 | −1.00 | −0.86 | −1.27 | −1.41 | −0.88 | −1.14 | −0.70 | −0.65 | 2 | HGG4 |
| 2786442 | −1.55 | −1.87 to −1.15 | −1.87 | −1.68 | −1.15 | −1.74 | −1.69 | −1.30 | −1.65 | −1.00 | −1.27 | 2 | HGG4 |
| 3042227 | −1.90 | −2.37 to −1.67 | −2.03 | −1.95 | −1.73 | −1.96 | −2.37 | −1.67 | −1.77 | −1.83 | −1.78 | 2 | HGG4 |

TABLE 10-continued

| Clone ID | Ave DE t/Bude | Range | mean DE t/Bude 1 μM, 1 hr | mean DE t/Bude 1 μM, 3 hr | mean DE t/Bude 1 μM, 6 hr | mean DE t/Bude 10 μM, 1 hr | mean DE t/Bude 10 μM, 3 hr | mean DE t/Bude 10 μM, 6 hr | mean DE t/Bude 100 μM, 1 hr | mean DE t/Bude 100 μM, 3 hr | mean DE t/Bude 100 μM, 6 hr | Cluster | GEM |
|---|---|---|---|---|---|---|---|---|---|---|---|---|---|
| 495808 | −1.16 | −1.44 to −0.94 | −1.44 | −1.41 | −1.04 | −0.94 | −1.18 | −1.11 | −1.12 | −1.17 | −1.01 | 2 | HGG4 |
| 1383138 | −1.14 | −1.93 to −0.54 | −0.54 | −1.12 | −1.20 | −0.73 | −1.93 | −1.30 | −0.62 | −1.46 | −1.34 | 2 | HGG4 |
| 1449819 | −1.23 | −2.05 to −0.11 | −0.62 | −1.11 | −1.88 | −0.11 | −1.25 | −2.05 | −0.44 | −1.90 | −1.71 | 2 | HGG4 |
| 5280239 | −1.02 | −1.41 to −0.47 | −1.18 | −1.11 | −0.47 | −1.20 | −1.41 | −0.64 | −1.12 | −1.11 | −0.97 | 2 | HGG4 |
| 1721320 | −0.97 | −1.56 to −0.74 | −0.74 | −0.78 | −0.90 | −0.93 | −1.56 | −1.01 | −0.94 | −0.97 | −0.90 | 2 | HGG4 |
| 1857850 | −2.23 | −2.73 to −1.90 | −1.90 | −1.95 | −2.07 | −2.34 | −2.73 | −2.28 | −2.25 | −2.26 | −2.31 | 2 | HGG4 |
| 1900173 | 0.78 | 0.00 to 1.44 | 1.44 | 0.00 | 0.00 | 1.18 | 1.06 | 0.82 | 0.89 | 0.71 | 0.91 | 3 | HGG4 |
| 278100 | 0.21 | 0.00 to 1.88 | 0.00 | 0.00 | 0.00 | 0.00 | 1.88 | 0.00 | 0.00 | 0.00 | 0.00 | 3 | HGG4 |
| 2013251 | 0.91 | 0.00 to 2.15 | 0.00 | 0.00 | 0.00 | 2.07 | 2.15 | 2.14 | 0.00 | 1.82 | 0.00 | 3 | HGG4 |
| 2803833 | 0.42 | 0.00 to 3.75 | 3.75 | 0.00 | 0.00 | 0.00 | 0.00 | 0.00 | 0.00 | 0.00 | 0.00 | 3 | HGG4 |
| 1495947 | 0.46 | 0.00 to 4.15 | 4.15 | 0.00 | 0.00 | 0.00 | 0.00 | 0.00 | 0.00 | 0.00 | 0.00 | 3 | HGG4 |
| 2404746 | 0.42 | 0.00 to 1.71 | 0.00 | 0.00 | 0.00 | 1.12 | 0.00 | 1.71 | 0.00 | 0.99 | 0.00 | 3 | HGG4 |
| 3149570 | 0.85 | 0.00 to 1.76 | 0.00 | 0.00 | 1.76 | 1.59 | 1.71 | 1.32 | 0.00 | 1.29 | 0.00 | 3 | HGG4 |
| 3188860 | 0.61 | 0.00 to 1.39 | 1.39 | 0.00 | 0.00 | 0.78 | 0.92 | 0.90 | 0.00 | 0.56 | 0.98 | 3 | HGG4 |
| 417432 | 0.65 | 0.00 to 1.33 | 0.00 | 0.00 | 1.33 | 1.20 | 0.00 | 1.27 | 0.89 | 1.19 | | 3 | HGG4 |
| 2405487 | 0.58 | 0.00 to 1.46 | 0.00 | 0.00 | 0.00 | 1.41 | 1.46 | 1.21 | 0.00 | 1.12 | 0.00 | 3 | HGG4 |
| 509839 | 0.77 | 0.00 to 2.01 | 0.00 | 0.00 | 0.00 | 1.76 | 0.00 | 1.64 | 0.00 | 1.49 | 2.01 | 3 | HGG4 |
| 2399665 | −0.70 | −1.66 to 0.00 | 0.00 | 0.00 | 0.00 | −1.66 | 0.00 | −1.32 | −1.15 | −1.17 | −0.98 | 4 | HGG4 |
| 1707037 | −0.23 | −1.89 to 0.00 | −1.89 | 0.00 | 0.00 | 0.00 | 0.00 | 0.00 | −0.16 | 0.00 | | 4 | HGG4 |
| 1662632 | −0.62 | −2.06 to 0.00 | −0.34 | 0.00 | 0.00 | −0.77 | −2.06 | −0.45 | −0.51 | −0.83 | −0.61 | 4 | HGG4 |
| 2347684 | −0.30 | −2.70 to 0.00 | 0.00 | 0.00 | 0.00 | −2.70 | 0.00 | 0.00 | 0.00 | 0.00 | 0.00 | 4 | HGG4 |
| 380041 | −0.37 | −1.33 to −0.06 | −0.06 | −0.29 | −0.18 | −0.35 | −1.33 | −0.31 | −0.24 | −0.27 | −0.30 | 4 | HGG4 |
| 4003460 | −0.71 | −1.63 to 0.00 | −0.29 | 0.00 | −0.32 | −0.78 | −1.63 | −0.94 | −0.88 | −0.77 | −0.80 | 4 | HGG4 |
| 4248767 | −0.51 | −1.38 to −0.14 | −0.14 | −0.22 | −0.59 | −0.23 | −1.38 | −0.72 | −0.26 | −0.55 | −0.51 | 4 | HGG4 |
| 1446475 | −0.70 | −1.43 to −0.34 | −0.34 | −0.46 | −0.64 | −0.46 | −1.43 | −0.84 | −0.46 | −0.73 | −0.91 | 4 | HGG4 |
| 5424122 | −0.87 | −1.47 to −0.35 | −0.83 | −0.81 | −0.35 | −1.19 | −1.47 | −0.71 | −1.07 | −0.92 | −0.45 | 4 | HGG4 |
| 1964758 | 2.52 | 2.21 to 2.77 | 2.77 | 2.67 | 2.57 | 2.52 | 2.65 | 2.21 | 2.51 | 2.30 | 2.47 | 5 | HGG4 |
| 2581075 | 4.07 | 3.77 to 4.29 | 4.28 | 4.24 | 4.06 | 4.15 | 4.29 | 3.95 | 3.77 | 3.85 | 4.04 | 5 | HGG4 |
| 1370137 | 2.80 | 2.51 to 2.97 | 2.97 | 2.92 | 2.89 | 2.79 | 2.91 | 2.80 | 2.64 | 2.51 | 2.80 | 5 | HGG4 |
| 2278772 | 3.00 | 2.46 to 3.50 | 3.02 | 3.50 | 2.94 | 3.27 | 3.28 | 3.03 | 2.63 | 2.46 | 2.87 | 5 | HGG4 |
| 1597837 | 0.46 | −0.02 to 3.03 | 0.14 | 0.14 | 0.23 | 0.13 | −0.02 | 0.02 | 3.03 | 0.12 | 0.39 | 6 | HGG4 |
| 1211357 | 0.19 | −0.15 to 1.80 | 0.23 | 0.00 | 0.03 | −0.15 | −0.05 | −0.09 | 1.80 | −0.03 | −0.02 | 6 | HGG4 |
| 5867032 | 0.19 | 0.00 to 1.71 | 0.00 | 0.00 | 0.00 | 0.00 | 0.00 | 0.00 | 1.71 | 0.03 | 0.00 | 6 | HGG4 |

TABLE 11

| | | | | | | | | | | | | | |
|---|---|---|---|---|---|---|---|---|---|---|---|---|---|
| 3031022 | −1.79 | −2.03 to −1.57 | −1.74 | −2.03 | −1.78 | −1.90 | −1.64 | −1.82 | −1.57 | −1.76 | −1.84 | 0 | HGG1 |
| 3001212 | −1.43 | −1.87 to −1.12 | −1.40 | −1.56 | −1.20 | −1.64 | −1.32 | −1.37 | −1.87 | −1.38 | −1.12 | 0 | HGG1 |
| 2042056 | −1.64 | −1.92 to −1.37 | −1.68 | −1.76 | −1.45 | −1.75 | −1.50 | −1.51 | −1.92 | −1.78 | −1.37 | 0 | HGG1 |
| 2047730 | −1.22 | −1.55 to −0.94 | −1.09 | −1.38 | −0.95 | −1.03 | −0.94 | −1.18 | −1.42 | −1.42 | −1.55 | 0 | HGG1 |
| 2055867 | −0.88 | −1.32 to −0.42 | −0.43 | −1.19 | −0.96 | −0.52 | −0.91 | −1.14 | −0.42 | −1.32 | −1.01 | 0 | HGG1 |
| 2061528 | −1.38 | −1.53 to −1.26 | −1.26 | −1.46 | −1.39 | −1.53 | −1.27 | −1.26 | −1.34 | −1.40 | −1.51 | 0 | HGG1 |
| 2912637 | −2.17 | −2.59 to −1.77 | −2.39 | −2.32 | −1.79 | −2.59 | −1.77 | −1.95 | −2.41 | −2.18 | −2.13 | 0 | HGG1 |
| 2495131 | −1.08 | −1.44 to −0.67 | −1.19 | −1.44 | −1.10 | −1.22 | −1.17 | −1.04 | −0.82 | −1.06 | −0.67 | 0 | HGG1 |
| 2252884 | −1.03 | −1.33 to −0.59 | −1.13 | −1.33 | −0.81 | −1.03 | −0.59 | −1.07 | −1.06 | −1.00 | −1.24 | 0 | HGG1 |
| 2285521 | −1.09 | −1.36 to −0.63 | −1.18 | 1.36 | −0.94 | −1.20 | −0.63 | −1.05 | −1.17 | −1.07 | −1.17 | 0 | HGG1 |
| 2506973 | −1.31 | −1.69 to 0.00 | −1.41 | −1.69 | −1.22 | −1.65 | −1.31 | −1.36 | 0.00 | −1.60 | −1.52 | 0 | HGG1 |
| 2886955 | −1.62 | −1.89 to −1.35 | −1.55 | −1.64 | −1.52 | −1.89 | −1.35 | −1.51 | −1.79 | −1.70 | −1.65 | 0 | HGG1 |
| 41479 | −1.21 | −1.49 to −0.94 | −1.20 | −1.36 | −0.94 | −0.96 | −1.21 | −1.24 | −1.49 | −1.24 | −1.22 | 0 | HGG1 |
| 4408943 | −1.54 | −1.66 to −1.37 | −1.37 | −1.66 | −1.37 | −1.43 | −1.52 | −1.62 | −1.58 | −1.62 | −1.65 | 0 | HGG1 |
| 4098018 | −1.03 | −1.32 to −0.84 | −0.86 | −0.99 | −0.92 | −1.12 | −0.84 | −0.88 | −1.15 | −1.25 | −1.32 | 0 | HGG1 |
| 5047895 | −1.44 | −1.81 to −1.22 | −1.22 | −1.40 | −1.32 | −1.23 | −1.27 | −1.62 | −1.46 | −1.61 | −1.81 | 0 | HGG1 |
| 5291518 | −1.26 | −1.41 to −1.09 | −1.24 | −1.41 | −1.22 | −1.09 | −1.23 | −1.29 | −1.20 | −1.31 | −1.34 | 0 | HGG1 |
| 5541828 | −1.74 | −2.18 to −1.50 | −1.50 | −1.63 | −1.54 | −1.66 | −1.53 | −1.63 | −1.93 | −2.04 | −2.18 | 0 | HGG1 |
| 560115 | −1.93 | −2.46 to −1.69 | −1.69 | −2.01 | −1.87 | −1.75 | −1.80 | −1.98 | −1.78 | −2.46 | −2.03 | 0 | HGG1 |
| 891072 | −1.14 | −1.33 to −0.96 | −0.99 | −1.33 | −1.03 | −1.28 | −0.96 | −1.15 | −1.09 | −1.14 | −1.23 | 0 | HGG1 |
| 1560906 | 1.28 | 0.91 to 1.62 | 1.42 | 1.44 | 1.14 | 1.62 | 1.29 | 0.91 | 1.38 | 1.07 | 1.26 | 1 | HGG1 |
| 1609387 | 1.02 | 0.75 to 1.35 | 1.08 | 1.15 | 0.82 | 1.25 | 0.91 | 0.75 | 1.35 | 0.80 | 1.03 | 1 | HGG1 |
| 1610828 | 1.09 | 0.81 to 1.49 | 1.12 | 1.16 | 0.81 | 1.49 | 1.03 | 0.95 | 1.31 | 0.88 | 1.07 | 1 | HGG1 |
| 2459765 | 1.17 | 0.96 to 1.38 | 1.23 | 1.29 | 0.96 | 1.20 | 1.16 | 1.05 | 1.22 | 1.03 | 1.38 | 1 | HGG1 |
| 2311213 | 1.06 | 0.71 to 1.37 | 1.02 | 0.88 | 0.71 | 0.97 | 1.05 | 1.04 | 1.32 | 1.17 | 1.37 | 1 | HGG1 |
| 1899766 | 0.91 | 0.66 to 1.35 | 0.69 | 0.98 | 1.10 | 0.93 | 1.35 | 0.83 | 0.95 | 0.66 | 0.68 | 1 | HGG1 |
| 1944123 | 1.14 | 0.97 to 1.38 | 1.14 | 1.24 | 0.97 | 1.38 | 1.20 | 1.00 | 1.26 | 0.97 | 1.07 | 1 | HGG1 |
| 305751 | 1.18 | 0.00 to 1.85 | 1.31 | 0.00 | 1.45 | 1.53 | 0.00 | 1.44 | 1.85 | 1.50 | 1.55 | 1 | HGG1 |
| 4286760 | 1.20 | 0.98 to 1.50 | 1.07 | 1.05 | 1.50 | 1.08 | 1.26 | 1.23 | 0.98 | 1.27 | 1.38 | 1 | HGG1 |
| 4289063 | 1.03 | 0.70 to 1.39 | 1.37 | 1.28 | 0.81 | 1.39 | 1.09 | 0.88 | 0.95 | 0.70 | 0.84 | 1 | HGG1 |
| 1004382 | 1.21 | 1.00 to 1.48 | 1.20 | 1.28 | 1.00 | 1.25 | 1.00 | 1.19 | 1.48 | 1.18 | 1.29 | 1 | HGG1 |
| 4021009 | 1.09 | 0.78 to 1.38 | 1.15 | 1.16 | 0.83 | 1.26 | 0.97 | 0.78 | 1.38 | 1.08 | 1.21 | 1 | HGG1 |
| 4978708 | 1.14 | 0.97 to 1.43 | 1.15 | 1.14 | 0.97 | 1.31 | 1.17 | 1.07 | 1.43 | 1.01 | 1.03 | 1 | HGG1 |
| 1241484 | 1.24 | 1.07 to 1.41 | 1.36 | 1.34 | 1.09 | 1.40 | 1.23 | 1.07 | 1.41 | 1.09 | 1.20 | 1 | HGG1 |
| 143765 | 1.24 | 0.86 to 1.43 | 1.34 | 1.28 | 0.86 | 1.38 | 1.12 | 1.15 | 1.41 | 1.22 | 1.43 | 1 | HGG1 |
| 531505 | 1.21 | 0.94 to 1.56 | 1.39 | 1.46 | 0.94 | 1.56 | 1.24 | 1.18 | 1.18 | 0.94 | 0.99 | 1 | HGG1 |
| 5397446 | 0.96 | 0.46 to 1.41 | 0.88 | 1.26 | 0.80 | 1.02 | 1.41 | 0.46 | 1.25 | 0.72 | 0.87 | 1 | HGG1 |
| 3497231 | 1.14 | 0.89 to 1.34 | 1.29 | 1.28 | 0.89 | 1.11 | 0.96 | 1.00 | 1.30 | 1.06 | 1.34 | 1 | HGG1 |
| 5543385 | 1.00 | 0.76 to 1.39 | 0.89 | 1.05 | 1.07 | 1.01 | 1.39 | 0.94 | 1.07 | 0.76 | 0.86 | 1 | HGG1 |

TABLE 11-continued

| | | | | | | | | | | | | | |
|---|---|---|---|---|---|---|---|---|---|---|---|---|---|
| 1521272 | 1.20 | 1.02 to 1.47 | 1.20 | 1.26 | 1.08 | 1.32 | 1.13 | 1.02 | 1.47 | 1.14 | 1.20 | 1 | HGG1 |
| 2756333 | 1.18 | 0.77 to 1.45 | 1.25 | 1.28 | 0.77 | 1.19 | 1.09 | 0.96 | 1.42 | 1.20 | 1.45 | 1 | HGG1 |
| 3595618 | 1.39 | 1.18 to 1.57 | 1.51 | 1.43 | 1.18 | 1.52 | 1.37 | 1.33 | 1.57 | 1.19 | 1.42 | 2 | HGG1 |
| 3606046 | 1.61 | 1.14 to 1.89 | 1.73 | 1.73 | 1.14 | 1.84 | 1.37 | 1.40 | 1.85 | 1.51 | 1.89 | 2 | HGG1 |
| 3687719 | 1.35 | 1.10 to 1.56 | 1.34 | 1.56 | 1.27 | 1.52 | 1.53 | 1.24 | 1.44 | 1.20 | 1.10 | 2 | HGG1 |
| 371201 | 1.27 | 0.97 to 1.53 | 0.97 | 1.41 | 1.08 | 1.27 | 1.07 | 1.19 | 1.53 | 1.40 | 1.49 | 2 | HGG1 |
| 3821432 | 1.37 | 1.05 to 1.64 | 1.42 | 1.49 | 1.05 | 1.44 | 1.19 | 1.27 | 1.53 | 1.27 | 1.64 | 2 | HGG1 |
| 1342744 | 1.50 | 1.24 to 1.70 | 1.60 | 1.70 | 1.24 | 1.56 | 1.46 | 1.35 | 1.64 | 1.32 | 1.60 | 2 | HGG1 |
| 1459743 | 1.45 | 1.17 to 1.66 | 1.48 | 1.66 | 1.17 | 1.56 | 1.43 | 1.25 | 1.59 | 1.28 | 1.62 | 2 | HGG1 |
| 1684617 | 1.54 | 1.07 to 1.86 | 1.60 | 1.63 | 1.07 | 1.80 | 1.25 | 1.22 | 1.84 | 1.57 | 1.86 | 2 | HGG1 |
| 1756875 | 1.26 | 0.88 to 1.68 | 1.21 | 1.32 | 0.88 | 1.33 | 1.15 | 1.05 | 1.46 | 1.28 | 1.68 | 2 | HGG1 |
| 2070126 | 1.49 | 1.24 to 1.76 | 1.37 | 1.65 | 1.40 | 1.59 | 1.24 | 1.47 | 1.76 | 1.45 | 1.47 | 2 | HGG1 |
| 2120743 | 1.36 | 0.97 to 1.85 | 1.35 | 1.56 | 0.97 | 1.34 | 1.04 | 1.08 | 1.85 | 1.49 | 1.59 | 2 | HGG1 |
| 5046235 | 1.28 | 0.86 to 1.68 | 0.86 | 1.33 | 1.35 | 1.13 | 1.17 | 1.19 | 1.68 | 1.42 | 1.44 | 2 | HGG1 |
| 2313349 | 1.50 | 1.26 to 1.69 | 1.55 | 1.67 | 1.26 | 1.65 | 1.44 | 1.35 | 1.69 | 1.35 | 1.55 | 2 | HGG1 |
| 2445967 | 1.37 | 1.13 to 1.68 | 1.49 | 1.51 | 1.28 | 1.68 | 1.29 | 1.23 | 1.48 | 1.13 | 1.19 | 2 | HGG1 |
| 2494284 | 1.57 | 0.97 to 2.27 | 1.16 | 1.63 | 1.21 | 1.34 | 0.97 | 1.39 | 2.27 | 2.09 | 2.11 | 2 | HGG1 |
| 2511277 | 1.57 | 1.19 to 1.86 | 1.57 | 1.56 | 1.19 | 1.78 | 1.65 | 1.31 | 1.86 | 1.56 | 1.65 | 2 | HGG1 |
| 2516950 | 1.54 | 1.30 to 1.80 | 1.63 | 1.67 | 1.30 | 1.80 | 1.37 | 1.35 | 1.70 | 1.42 | 1.60 | 2 | HGG1 |
| 2697275 | 1.32 | 0.85 to 1.72 | 1.38 | 1.38 | 0.85 | 1.22 | 0.94 | 1.23 | 1.72 | 1.44 | 1.70 | 2 | HGG1 |
| 2778441 | 1.45 | 1.21 to 1.62 | 1.51 | 1.57 | 1.26 | 1.62 | 1.48 | 1.28 | 1.46 | 1.21 | 1.62 | 2 | HGG1 |
| 671717 | 1.38 | 1.00 to 1.72 | 1.39 | 1.46 | 1.00 | 1.46 | 1.26 | 1.30 | 1.72 | 1.30 | 1.53 | 2 | HGG1 |
| 2833342 | 1.38 | 1.12 to 1.54 | 1.50 | 1.54 | 1.12 | 1.43 | 1.21 | 1.31 | 1.54 | 1.25 | 1.54 | 2 | HGG1 |
| 1457424 | 2.30 | 1.93 to 2.70 | 2.70 | 2.68 | 1.93 | 2.58 | 2.17 | 2.12 | 2.28 | 1.98 | 2.24 | 3 | HGG1 |
| 617587 | 1.89 | 1.53 to 2.31 | 1.67 | 1.96 | 1.54 | 1.90 | 1.89 | 1.53 | 2.24 | 1.95 | 2.31 | 3 | HGG1 |
| 459372 | 1.86 | 1.59 to 2.10 | 2.07 | 2.07 | 1.59 | 2.10 | 1.60 | 1.61 | 2.05 | 1.82 | 1.81 | 3 | HGG1 |
| 2956444 | 1.76 | 1.38 to 2.10 | 1.98 | 1.94 | 1.38 | 2.10 | 1.66 | 1.55 | 1.87 | 1.50 | 1.87 | 3 | HGG1 |
| 3792988 | 1.88 | 1.58 to 2.19 | 1.92 | 1.96 | 1.58 | 2.19 | 1.71 | 1.59 | 2.12 | 1.78 | 2.04 | 3 | HGG1 |
| 2823767 | 1.77 | 1.47 to 2.07 | 1.89 | 1.96 | 1.47 | 2.07 | 1.61 | 1.64 | 1.90 | 1.48 | 1.87 | 3 | HGG1 |
| 1320685 | 1.85 | 1.57 to 2.05 | 1.85 | 2.05 | 1.72 | 1.84 | 1.57 | 1.80 | 2.04 | 1.80 | 1.95 | 3 | HGG1 |
| 1956982 | 1.71 | 1.28 to 2.11 | 1.96 | 1.84 | 1.83 | 1.90 | 2.11 | 1.65 | 1.44 | 1.35 | 1.28 | 3 | HGG1 |
| 3068809 | 1.94 | 1.67 to 2.15 | 2.05 | 2.01 | 1.82 | 2.15 | 2.03 | 1.82 | 2.05 | 1.67 | 1.84 | 3 | HGG1 |
| 2520894 | 2.04 | 1.54 to 2.48 | 1.99 | 2.14 | 1.54 | 2.21 | 1.85 | 1.73 | 2.40 | 2.06 | 2.48 | 3 | HGG1 |
| 548114 | 1.79 | 1.34 to 2.20 | 1.84 | 1.84 | 1.34 | 1.79 | 1.67 | 1.48 | 2.20 | 1.95 | 2.05 | 3 | HGG1 |
| 4287327 | 2.18 | 1.78 to 2.68 | 1.78 | 2.06 | 2.08 | 1.79 | 2.45 | 1.90 | 2.25 | 2.68 | 2.61 | 3 | HGG1 |
| 5509134 | 2.11 | 1.75 to 2.56 | 2.24 | 2.08 | 1.96 | 2.56 | 2.29 | 1.96 | 2.21 | 1.75 | 1.91 | 3 | HGG1 |
| 2110430 | 1.97 | 1.65 to 2.27 | 1.91 | 2.17 | 1.84 | 2.17 | 2.00 | 1.65 | 2.27 | 1.81 | 1.87 | 3 | HGG1 |
| 2908212 | 0.42 | 0.00 to 1.79 | 1.79 | 0.00 | 0.00 | 0.00 | 0.00 | 1.09 | 0.00 | 0.89 | 0.00 | 4 | HGG1 |
| 3049285 | −0.37 | −4.42 to 0.44 | 0.24 | 0.00 | 0.44 | 0.00 | 0.00 | 0.25 | 0.00 | 0.16 | −4.42 | 4 | HGG1 |

TABLE 11-continued

| | | | | | | | | | | | | | |
|---|---|---|---|---|---|---|---|---|---|---|---|---|---|
| 2019910 | 0.19 | 0.00 to 1.39 | 0.00 | 0.00 | 0.00 | 0.00 | 0.00 | 1.39 | 0.00 | 0.34 | 0.00 | 4 | HGG 1 |
| 168848 | −0.24 | −4.65 to 0.67 | 0.67 | 0.00 | 0.58 | 0.63 | 0.00 | 0.63 | 0.00 | −4.65 | 0.00 | 4 | HGG 1 |
| 2018808 | 0.21 | −0.11 to 1.40 | 0.08 | 0.13 | 0.04 | 0.05 | −0.11 | 1.40 | 0.27 | 0.01 | 0.06 | 4 | HGG 1 |
| 2358261 | 0.31 | 0.00 to 1.51 | 0.00 | 0.00 | 0.00 | 0.00 | 0.00 | 1.51 | 0.00 | 1.25 | 0.00 | 4 | HGG 1 |
| 2403438 | 1.35 | 0.00 to 2.03 | 1.75 | 1.67 | 1.16 | 2.03 | 1.19 | 1.18 | 0.00 | 1.55 | 1.62 | 5 | HGG 1 |
| 4630674 | 0.86 | 0.00 to 1.46 | 1.26 | 1.45 | 1.33 | 1.46 | 0.00 | 1.06 | 0.00 | 1.22 | 0.00 | 5 | HGG 1 |
| 3391835 | 1.34 | 0.00 to 2.04 | 1.79 | 1.78 | 1.50 | 1.51 | 0.00 | 1.46 | 0.00 | 1.95 | 2.04 | 5 | HGG 1 |
| 1210839 | 1.11 | 0.00 to 1.56 | 1.39 | 1.47 | 0.92 | 1.25 | 0.98 | 1.14 | 0.00 | 1.28 | 1.56 | 5 | HGG 1 |
| 4092112 | 1.17 | 0.00 to 1.60 | 1.31 | 1.36 | 0.99 | 1.51 | 1.44 | 1.12 | 0.00 | 1.23 | 1.60 | 5 | HGG 1 |
| 2818476 | 2.70 | 2.27 to 3.31 | 2.85 | 2.77 | 2.27 | 3.31 | 2.69 | 2.45 | 2.60 | 2.57 | 2.80 | 6 | HGG 1 |
| 4549259 | 2.98 | 2.64 to 3.27 | 3.03 | 3.12 | 2.64 | 3.15 | 2.79 | 2.72 | 3.23 | 2.90 | 3.27 | 6 | HGG 1 |
| 1630990 | 2.94 | 2.39 to 3.84 | 3.60 | 3.48 | 2.43 | 3.84 | 2.79 | 2.60 | 2.72 | 2.39 | 2.57 | 6 | HGG 1 |
| 2755836 | 3.39 | 2.78 to 4.04 | 3.76 | 3.64 | 2.78 | 4.04 | 3.29 | 3.17 | 3.39 | 3.06 | 3.40 | 6 | HGG 1 |
| 1527302 | 0.67 | 0.00 to 2.21 | 0.76 | 0.00 | 0.75 | 0.71 | 0.00 | 2.21 | 0.00 | 0.77 | 0.85 | 7 | HGG 1 |
| 279898 | 0.97 | 0.07 to 1.83 | 0.27 | 1.11 | 1.83 | 0.07 | 1.29 | 1.48 | 0.64 | 0.93 | 1.10 | 7 | HGG 1 |
| 136073 | 0.81 | 0.00 to 1.42 | 1.01 | 1.23 | 0.77 | 0.00 | 0.93 | 0.90 | 0.00 | 1.04 | 1.42 | 7 | HGG 1 |
| 5501676 | 1.79 | 0.00 to 3.00 | 2.73 | 2.53 | 1.66 | 3.00 | 2.35 | 1.85 | 0.00 | 2.00 | 0.00 | 8 | HGG 1 |
| 2499976 | 1.00 | 0.71 to 1.38 | 1.00 | 1.00 | 0.71 | 1.21 | 0.93 | 0.89 | 1.38 | 0.90 | 0.98 | 0 | HGG 2 |
| 1709709 | 1.27 | 0.99 to 1.55 | 1.33 | 1.35 | 0.99 | 1.54 | 1.18 | 1.10 | 1.55 | 1.15 | 1.27 | 0 | HGG 2 |
| 2230608 | 1.11 | 0.76 to 1.37 | 1.18 | 1.18 | 0.76 | 1.30 | 0.99 | 1.00 | 1.37 | 1.04 | 1.17 | 0 | HGG 2 |
| 1559844 | 1.20 | 0.99 to 1.38 | 1.32 | 1.30 | 0.99 | 1.32 | 1.27 | 0.99 | 1.38 | 1.10 | 1.12 | 0 | HGG 2 |
| 1679595 | 0.99 | 0.68 to 1.33 | 0.97 | 1.08 | 0.68 | 1.18 | 0.86 | 1.00 | 1.33 | 0.91 | 0.95 | 0 | HGG 2 |
| 1407125 | 1.44 | 1.17 to 1.73 | 1.57 | 1.60 | 1.17 | 1.59 | 1.44 | 1.24 | 1.73 | 1.33 | 1.30 | 0 | HGG 2 |
| 1988540 | 1.72 | 1.36 to 2.13 | 2.13 | 1.93 | 1.55 | 2.09 | 1.68 | 1.45 | 1.87 | 1.36 | 1.43 | 0 | HGG 2 |
| 2021989 | 1.06 | 0.00 to 1.43 | 1.16 | 1.25 | 1.01 | 1.43 | 1.31 | 1.13 | 0.00 | 1.21 | 1.07 | 0 | HGG 2 |
| 2725369 | 1.16 | 0.83 to 1.78 | 0.83 | 1.33 | 1.10 | 1.02 | 0.89 | 1.06 | 1.78 | 1.25 | 1.17 | 0 | HGG 2 |
| 2837006 | 0.95 | 0.00 to 1.73 | 0.00 | 0.00 | 0.00 | 1.68 | 1.20 | 1.15 | 1.73 | 1.30 | 1.50 | 0 | HGG 2 |
| 3206352 | 1.62 | 1.23 to 2.07 | 1.69 | 1.72 | 1.23 | 2.07 | 1.63 | 1.45 | 1.80 | 1.44 | 1.59 | 0 | HGG 2 |
| 755223 | 1.13 | 0.89 to 1.44 | 1.24 | 1.23 | 0.89 | 1.20 | 0.91 | 1.06 | 1.44 | 1.06 | 1.18 | 0 | HGG 2 |
| 870396 | 0.93 | 0.63 to 1.40 | 1.24 | 1.20 | 0.63 | 1.40 | 0.90 | 0.74 | 1.00 | 0.63 | 0.66 | 0 | HGG 2 |
| 960604 | 1.34 | 0.00 to 1.71 | 1.67 | 1.47 | 1.21 | 1.70 | 1.71 | 1.48 | 0.00 | 1.37 | 1.46 | 0 | HGG 2 |
| 2086783 | −1.13 | −1.37 to −0.75 | −1.37 | −1.26 | −1.05 | −1.20 | −0.75 | −1.18 | −1.10 | −1.15 | −1.16 | 1 | HGG 2 |
| 2269058 | −1.06 | −1.37 to −0.68 | −1.17 | −1.37 | −0.96 | −1.12 | −0.68 | −1.10 | −1.07 | −0.98 | −1.06 | 1 | HGG 2 |
| 2253102 | −1.13 | −1.36 to −0.77 | −1.36 | −1.28 | −1.05 | −1.17 | −0.77 | −1.14 | −1.08 | −1.17 | −1.14 | 1 | HGG 2 |
| 2088104 | −1.15 | −1.37 to −0.78 | −1.34 | −1.37 | −1.03 | −1.18 | −0.78 | −1.15 | −1.18 | −1.16 | −1.19 | 1 | HGG 2 |
| 2095329 | −1.21 | −1.48 to −0.87 | −1.45 | −1.48 | −1.10 | −1.26 | −0.87 | −1.21 | −1.15 | −1.19 | −1.18 | 1 | HGG 2 |
| 1401312 | −0.82 | −1.42 to 0.00 | −1.10 | −1.17 | −0.57 | −1.42 | −0.73 | −0.70 | 0.00 | −0.82 | −0.88 | 1 | HGG 2 |
| 2469891 | −1.14 | −1.44 to −0.87 | −1.36 | −1.44 | −1.05 | −1.30 | −0.87 | −1.18 | −0.90 | −1.09 | −1.05 | 1 | HGG 2 |
| 3421730 | −1.07 | −1.45 to −0.30 | −1.04 | −1.08 | −1.45 | −0.86 | −1.13 | −1.27 | −0.30 | −1.20 | −1.26 | 1 | HGG 2 |

TABLE 11-continued

| | | | | | | | | | | | | | |
|---|---|---|---|---|---|---|---|---|---|---|---|---|---|
| 2453558 | −1.28 | −1.43 to −0.97 | −1.37 | −1.32 | −1.26 | −1.31 | 0.97 | −1.27 | −1.32 | −1.43 | −1.30 | 1 | HGG 2 |
| 2287703 | −1.07 | −1.32 to −0.71 | −1.28 | −1.32 | −0.93 | −1.16 | −0.71 | −1.12 | −1.01 | −1.06 | −1.05 | 1 | HGG 2 |
| 1753283 | −1.16 | −1.69 to 0.00 | −1.05 | −1.43 | −1.28 | −1.69 | −0.68 | −1.36 | 0.00 | −1.47 | −1.51 | 1 | HGG 2 |
| 2544622 | 2.44 | 0.00 to 3.28 | 3.28 | 2.88 | 2.22 | 3.28 | 2.73 | 2.57 | 0.00 | 2.39 | 2.61 | 2 | HGG 2 |
| 1303862 | 2.71 | 0.00 to 3.98 | 3.98 | 3.49 | 2.41 | 3.81 | 3.06 | 2.37 | 0.00 | 2.59 | 2.69 | 2 | HGG 2 |
| 1316801 | 1.87 | 0.00 to 2.61 | 0.00 | 2.34 | 1.92 | 2.61 | 1.75 | 1.87 | 2.39 | 1.84 | 2.12 | 2 | HGG 2 |
| 1326255 | 3.31 | 2.93 to 3.65 | 3.10 | 3.39 | 2.93 | 3.47 | 3.62 | 3.46 | 3.65 | 3.02 | 3.13 | 2 | HGG 2 |
| 1961617 | 1.84 | 0.00 to 3.29 | 0.00 | 2.92 | 1.92 | 3.29 | 2.12 | 2.12 | 0.00 | 2.04 | 2.13 | 2 | HGG 2 |
| 660142 | 2.53 | 2.08 to 3.11 | 2.63 | 2.65 | 2.08 | 3.11 | 2.28 | 2.24 | 2.81 | 2.49 | 2.47 | 2 | HGG 2 |
| 2124056 | 2.52 | 2.25 to 2.94 | 2.45 | 2.74 | 2.50 | 2.54 | 2.25 | 2.48 | 2.94 | 2.37 | 2.42 | 2 | HGG 2 |
| 2234266 | 2.01 | 0.00 to 3.42 | 0.00 | 3.17 | 2.29 | 3.42 | 2.45 | 2.42 | 0.00 | 2.11 | 2.27 | 2 | HGG 2 |
| 2394990 | 1.67 | 0.00 to 2.38 | 2.37 | 2.12 | 1.72 | 2.38 | 2.13 | 1.72 | 0.00 | 1.30 | 1.33 | 2 | HGG 2 |
| 1926934 | 0.54 | 0.00 to 1.73 | 0.00 | 0.00 | 1.45 | 0.00 | 0.00 | 0.00 | 0.00 | 1.63 | 1.73 | 3 | HGG 2 |
| 2817244 | 0.20 | −0.30 to 2.39 | 0.00 | 2.39 | 0.00 | 0.00 | 0.00 | 0.00 | 0.00 | −0.30 | −0.25 | 3 | HGG 2 |
| 2018315 | 0.90 | 0.00 to 1.69 | 1.34 | 1.69 | 1.19 | 0.00 | 0.00 | 1.23 | 0.00 | 1.30 | 1.31 | 3 | HGG 2 |
| 2607834 | 0.29 | 0.00 to 1.72 | 0.00 | 0.00 | 0.00 | 0.00 | 0.00 | 0.00 | 0.00 | 0.93 | 1.72 | 3 | HGG 2 |
| 1487428 | 0.73 | 0.00 to 2.24 | 0.00 | 2.24 | 1.78 | 0.00 | 0.00 | 0.00 | 0.00 | 1.27 | 1.31 | 3 | HGG 2 |
| 1418276 | 0.24 | 0.00 to 1.92 | 0.00 | 0.00 | 0.00 | 0.00 | 0.00 | 0.00 | 0.00 | 0.23 | 1.92 | 3 | HGG 2 |
| 626471 | 0.76 | 0.00 to 1.51 | 0.00 | 0.00 | 1.15 | 0.00 | 1.26 | 1.39 | 0.00 | 1.51 | 1.50 | 3 | HGG 2 |
| 1235345 | 0.20 | 0.00 to 1.48 | 0.00 | 0.00 | 0.00 | 0.00 | 0.00 | 0.00 | 0.00 | 0.36 | 1.48 | 3 | HGG 2 |
| 3100048 | −1.13 | −1.78 to −0.07 | −0.50 | −1.50 | −1.32 | −0.59 | −1.52 | −1.31 | −0.07 | −1.78 | −1.56 | 4 | HGG 2 |
| 1988774 | −1.45 | −1.97 to −0.93 | −1.21 | −1.75 | −1.42 | −0.95 | −1.61 | −1.65 | −0.93 | −1.97 | −1.56 | 4 | HGG 2 |
| 2703122 | −1.54 | −1.78 to −1.33 | −1.59 | −1.78 | −1.56 | −1.62 | −1.33 | −1.59 | −1.50 | 1.51 | −1.41 | 4 | HGG 2 |
| 1251065 | 1.18 | 0.92 to 1.42 | 1.33 | 1.31 | 1.00 | 1.39 | 0.93 | 1.42 | 0.92 | 1.18 | | 0 | HGG 3 |
| 5266376 | 1.04 | 0.79 to 1.45 | 1.08 | 1.01 | 0.80 | 1.19 | 0.79 | 1.45 | 0.92 | 1.10 | | 0 | HGG 3 |
| 1570534 | 1.01 | 0.58 to 1.47 | 1.43 | 1.33 | 0.80 | 1.47 | 0.77 | 1.03 | 0.58 | 0.68 | | 0 | HGG 3 |
| 1786554 | 1.42 | 1.02 to 1.72 | 1.64 | 1.72 | 1.20 | 1.66 | 1.02 | 1.65 | 1.12 | 1.35 | | 0 | HGG 3 |
| 1905006 | 0.85 | 0.59 to 1.46 | 0.59 | 0.71 | 0.65 | 0.94 | 0.61 | 1.46 | 0.85 | 0.97 | | 0 | HGG 3 |
| 5508135 | 1.02 | 0.00 to 2.06 | 1.82 | 2.06 | 0.00 | 0.00 | 1.26 | 0.00 | 1.40 | 1.62 | | 0 | HGG 3 |
| 4543123 | 1.27 | 0.82 to 1.62 | 1.56 | 1.48 | 1.36 | 1.62 | 1.17 | 1.20 | 0.82 | 0.94 | | 0 | HGG 3 |
| 4508879 | 0.78 | 0.00 to 1.38 | 1.38 | 0.00 | 0.80 | 1.26 | 0.59 | 0.70 | 0.58 | 0.90 | | 0 | HGG 3 |
| 4252872 | 0.77 | 0.00 to 1.38 | 1.17 | 1.38 | 0.00 | 0.00 | 0.62 | 1.07 | 0.78 | 1.15 | | 0 | HGG 3 |
| 3960194 | 1.01 | 0.79 to 1.43 | 1.20 | 1.03 | 0.80 | 0.93 | 0.79 | 1.43 | 1.05 | 0.83 | | 0 | HGG 3 |
| 554654 | 0.89 | 0.27 to 1.82 | 1.82 | 1.27 | 0.61 | 1.03 | 0.63 | 1.06 | 0.44 | 0.27 | | 0 | HGG 3 |
| 748477 | 1.20 | 0.98 to 1.57 | 1.12 | 1.14 | 0.98 | 1.34 | 1.22 | 1.57 | 1.01 | 1.24 | | 0 | HGG 3 |
| 2871076 | 1.11 | 0.61 to 1.50 | 1.45 | 1.49 | 0.96 | 1.50 | 0.61 | 1.07 | 0.68 | 1.11 | | 0 | HGG 3 |
| 2972013 | 1.38 | 1.01 to 1.82 | 1.82 | 1.72 | 1.01 | 1.58 | 1.07 | 1.48 | 1.04 | 1.32 | | 0 | HGG 3 |
| 3068978 | 1.21 | 0.00 to 3.53 | 0.00 | 0.00 | 0.00 | 0.00 | 3.53 | 0.00 | 2.86 | 3.27 | | 0 | HGG 3 |
| 3034889 | 1.21 | 0.88 to 1.62 | 1.45 | 1.62 | 0.92 | 1.28 | 0.88 | 1.41 | 0.97 | 1.12 | | 0 | HGG 3 |

TABLE 11-continued

| | | | | | | | | | | | | |
|---|---|---|---|---|---|---|---|---|---|---|---|---|
| 5322365 | 1.40 | 1.03 to 1.75 | 1.68 | 1.75 | 1.03 | 1.51 | 1.07 | 1.59 | 1.19 | 1.38 | 0 | HGG 3 |
| 3495173 | 1.25 | 0.86 to 1.54 | 1.46 | 1.54 | 1.27 | 1.43 | 0.86 | 1.39 | 0.95 | 1.09 | 0 | HGG 3 |
| 1560380 | 0.39 | 0.00 to 1.57 | 0.00 | 0.00 | 0.00 | 0.00 | 1.57 | 0.00 | 1.56 | 0.00 | 1 | HGG 3 |
| 2195427 | 0.17 | 0.00 to 1.34 | 0.00 | 0.00 | 0.00 | 0.00 | 0.00 | 0.00 | 1.34 | 0.00 | 1 | HGG 3 |
| 3456829 | 0.44 | 0.00 to 2.15 | 0.44 | 2.15 | 0.28 | 0.00 | 0.44 | 0.00 | 0.21 | 0.00 | 1 | HGG 3 |
| 3478570 | 0.49 | 0.17 to 1.38 | 0.33 | 0.35 | 0.26 | 0.54 | 0.17 | 1.38 | 0.41 | 0.48 | 1 | HGG 3 |
| 5326983 | 0.50 | 0.00 to 1.36 | 1.13 | 1.36 | 0.00 | 0.00 | 0.66 | 0.00 | 0.82 | 0.00 | 1 | HGG 3 |
| 2769732 | 0.33 | −0.14 to 2.05 | −0.14 | 2.05 | 0.11 | 0.11 | 0.02 | 0.29 | 0.06 | 0.16 | 1 | HGG 3 |
| 2836703 | 0.65 | 0.00 to 1.87 | 1.87 | 1.50 | 0.46 | 0.00 | 0.35 | 0.53 | 0.13 | 0.36 | 1 | HGG 3 |
| 3974247 | 0.63 | 0.00 to 1.52 | 1.44 | 1.52 | 0.00 | 0.00 | 0.98 | 0.00 | 1.09 | 0.00 | 1 | HGG 3 |
| 4208369 | 0.12 | −0.28 to 1.40 | 0.00 | 0.00 | −0.28 | −0.01 | −0.07 | 1.40 | −0.08 | 0.00 | 1 | HGG 3 |
| 626254 | 0.35 | 0.00 to 2.57 | 0.00 | 0.00 | 0.00 | 0.00 | 0.26 | 0.00 | 2.57 | 0.00 | 1 | HGG 3 |
| 664625 | 0.36 | 0.00 to 1.62 | 1.62 | 0.00 | 0.00 | 0.00 | 0.00 | 0.00 | 1.23 | 0.00 | 1 | HGG 3 |
| 3031872 | 0.15 | −0.17 to 1.53 | −0.02 | −0.10 | −0.17 | 0.00 | −0.07 | 1.53 | −0.02 | 0.07 | 1 | HGG 3 |
| 872017 | 0.61 | 0.00 to 1.83 | 1.83 | 0.00 | 0.00 | 0.00 | 1.53 | 0.00 | 1.53 | 0.00 | 1 | HGG 3 |
| 4253809 | 1.82 | 1.49 to 2.12 | 2.09 | 1.89 | 1.49 | 1.95 | 1.52 | 2.12 | 1.79 | 1.73 | 2 | HGG 3 |
| 4402555 | 2.21 | 1.93 to 2.54 | 2.22 | 2.27 | 2.19 | 2.54 | 1.93 | 2.19 | 2.06 | 2.25 | 2 | HGG 3 |
| 4912315 | 1.99 | 1.41 to 2.90 | 2.47 | 2.08 | 1.89 | 2.90 | 1.41 | 1.80 | 1.46 | 1.94 | 2 | HGG 3 |
| 5102731 | 1.55 | 1.09 to 2.28 | 2.28 | 2.09 | 1.14 | 1.61 | 1.09 | 1.53 | 1.23 | 1.46 | 2 | HGG 3 |
| 5266015 | 2.38 | 2.00 to 2.65 | 2.36 | 2.44 | 2.18 | 2.62 | 2.00 | 2.65 | 2.27 | 2.50 | 2 | HGG 3 |
| 5293028 | 1.87 | 1.24 to 2.47 | 2.47 | 2.10 | 1.83 | 2.44 | 1.79 | 1.66 | 1.24 | 1.41 | 2 | HGG 3 |
| 5512044 | 1.71 | 1.41 to 2.02 | 1.74 | 1.72 | 1.81 | 2.02 | 1.43 | 1.85 | 1.41 | 1.68 | 2 | HGG 3 |
| 2343348 | 1.71 | 1.29 to 2.29 | 2.13 | 1.89 | 1.43 | 2.29 | 1.29 | 1.64 | 1.42 | 1.62 | 2 | HGG 3 |
| 621543 | 1.74 | 1.39 to 2.10 | 1.58 | 1.79 | 1.59 | 2.10 | 1.49 | 1.91 | 1.39 | 2.04 | 2 | HGG 3 |
| 2545486 | 2.07 | 1.60 to 2.39 | 2.10 | 2.32 | 2.33 | 2.39 | 1.87 | 1.92 | 1.60 | 2.04 | 2 | HGG 3 |
| 3074113 | 2.13 | 1.78 to 2.67 | 2.43 | 2.27 | 1.90 | 2.67 | 1.87 | 2.08 | 1.78 | 2.05 | 2 | HGG 3 |
| 3158828 | 1.66 | 1.30 to 2.20 | 1.61 | 1.63 | 1.48 | 2.20 | 1.30 | 1.85 | 1.44 | 1.77 | 2 | HGG 3 |
| 3957354 | 1.84 | 0.00 to 3.42 | 3.42 | 3.36 | 0.00 | 0.00 | 2.71 | 0.00 | 2.48 | 2.75 | 2 | HGG 3 |
| 3125211 | −1.14 | −1.54 to −0.90 | −1.22 | −1.20 | −0.90 | −1.54 | −1.11 | −1.10 | −0.97 | −1.06 | 3 | HGG 3 |
| 5166479 | −1.56 | −1.87 to −0.89 | −1.54 | −1.79 | −1.87 | −1.42 | −1.87 | −0.89 | −1.70 | −1.43 | 3 | HGG 3 |
| 2698777 | −1.25 | −1.45 to −1.00 | −1.10 | −1.33 | −1.31 | −1.45 | −1.31 | −1.00 | −1.21 | −1.27 | 3 | HGG 3 |
| 1911443 | −1.07 | −1.50 to −0.43 | −0.69 | −1.19 | −1.47 | −0.92 | −1.30 | −0.43 | −1.07 | −1.50 | 3 | HGG 3 |
| 4266051 | −0.90 | −1.39 to −0.69 | −0.75 | −0.69 | −0.98 | −1.39 | −0.85 | −0.78 | −0.75 | −1.04 | 3 | HGG 3 |
| 3097624 | −1.34 | −1.66 to −1.17 | −1.37 | −1.24 | −1.40 | −1.66 | −1.26 | −1.17 | −1.36 | −1.30 | 3 | HGG 3 |
| 4894508 | −1.03 | −1.36 to −0.87 | 0.87 | −1.09 | −1.01 | −1.36 | −0.99 | −0.97 | −1.02 | −0.95 | 3 | HGG 3 |
| 3135460 | −1.33 | −1.69 to −0.93 | −1.01 | −1.44 | −1.50 | −1.06 | −1.69 | −0.93 | −1.34 | −1.65 | 3 | HGG 3 |
| 5091002 | −1.22 | −1.58 to −0.87 | −1.03 | −0.87 | −1.29 | −1.51 | −1.19 | −1.16 | −1.16 | −1.58 | 3 | HGG 3 |
| 4289557 | −1.97 | −2.44 to −1.77 | −1.89 | −2.12 | −1.84 | −2.44 | −1.77 | −1.87 | −1.82 | −1.98 | 4 | HGG 3 |
| 5573549 | −1.70 | −2.00 to −1.51 | −1.69 | −1.86 | −1.78 | −2.00 | −1.55 | −1.51 | −1.53 | −1.67 | 4 | HGG 3 |

TABLE 11-continued

| | | | | | | | | | | | | | |
|---|---|---|---|---|---|---|---|---|---|---|---|---|---|
| 3120209 | −1.75 | −2.64 to −1.23 | −2.06 | −1.57 | −1.23 | −2.64 | −1.31 | −2.24 | −1.60 | −1.35 | | 4 | HGG 3 |
| 3778404 | −1.68 | −1.94 to −1.41 | −1.41 | −1.75 | −1.51 | −1.94 | −1.55 | −1.85 | −1.74 | −1.68 | | 4 | HGG 3 |
| 3084204 | −1.55 | −1.94 to −1.33 | −1.51 | −1.61 | −1.43 | −1.94 | −1.39 | −1.61 | −1.33 | −1.55 | | 4 | HGG 3 |
| 5427710 | −2.08 | −2.48 to −1.82 | −2.09 | −1.99 | −1.88 | −2.48 | −1.82 | −2.13 | −1.99 | −2.22 | | 4 | HGG 3 |
| 3069190 | 3.73 | 3.22 to 4.08 | 3.59 | 3.92 | 3.60 | 4.08 | 3.22 | 4.03 | 3.57 | 3.80 | | 5 | HGG 3 |
| 3172265 | 3.81 | 3.07 to 4.74 | 4.16 | 4.02 | 4.08 | 4.74 | 3.44 | 3.56 | 3.07 | 3.42 | | 5 | HGG 3 |
| 3629043 | 0.73 | 0.38 to 1.38 | 0.68 | 0.75 | 0.49 | 0.71 | 0.65 | 0.70 | 1.38 | 0.83 | 0.38 | 0 | HGG 4 |
| 1946155 | 0.92 | 0.59 to 1.56 | 0.94 | 0.99 | 0.74 | 1.01 | 0.61 | 0.82 | 1.56 | 0.98 | 0.59 | 0 | HGG 4 |
| 417432 | 0.93 | 0.56 to 1.46 | 0.97 | 1.04 | 0.80 | 1.13 | 0.83 | 0.78 | 1.46 | 0.84 | 0.56 | 0 | HGG 4 |
| 1448572 | 1.00 | 0.53 to 1.44 | 0.86 | 1.05 | 0.98 | 0.82 | 1.44 | 1.01 | 1.41 | 0.86 | 0.53 | 0 | HGG 4 |
| 409209 | 0.86 | 0.58 to 1.66 | 0.72 | 0.74 | 0.58 | 0.89 | 0.59 | 0.63 | 1.66 | 0.92 | 0.98 | 0 | HGG 4 |
| 2756587 | 1.01 | 0.59 to 1.50 | 1.14 | 1.09 | 0.80 | 1.23 | 0.91 | 0.86 | 1.50 | 0.92 | 0.59 | 0 | HGG 4 |
| 1611629 | 0.94 | 0.68 to 1.57 | 0.85 | 1.03 | 0.83 | 1.05 | 0.73 | 0.81 | 1.57 | 0.96 | 0.68 | 0 | HGG 4 |
| 1716458 | 1.03 | 0.73 to 1.39 | 1.20 | 1.19 | 0.73 | 1.13 | 1.00 | 0.76 | 1.39 | 0.92 | 0.96 | 0 | HGG 4 |
| 1730026 | 1.04 | 0.72 to 1.73 | 1.02 | 1.09 | 0.72 | 1.18 | 0.85 | 0.90 | 1.73 | 0.95 | 0.91 | 0 | HGG 4 |
| 1740179 | 0.86 | 0.65 to 1.35 | 0.95 | 0.91 | 0.65 | 0.97 | 0.67 | 0.73 | 1.35 | 0.76 | 0.78 | 0 | HGG 4 |
| 2007730 | 1.18 | 0.97 to 1.76 | 1.13 | 1.22 | 0.97 | 1.07 | 1.14 | 1.20 | 1.76 | 1.09 | 1.07 | 0 | HGG 4 |
| 2751922 | 1.09 | 0.62 to 1.53 | 0.87 | 1.25 | 1.18 | 1.08 | 1.39 | 1.00 | 1.53 | 0.87 | 0.62 | 0 | HGG 4 |
| 2062085 | 1.05 | 0.77 to 1.54 | 1.02 | 1.14 | 0.77 | 1.21 | 0.79 | 1.16 | 1.54 | 0.91 | 0.93 | 0 | HGG 4 |
| 2196870 | 1.05 | 0.81 to 1.52 | 1.00 | 1.04 | 0.81 | 1.09 | 1.02 | 1.08 | 1.52 | 0.88 | 0.98 | 0 | HGG 4 |
| 2227273 | 1.01 | 0.76 to 1.66 | 0.80 | 1.09 | 0.93 | 0.89 | 0.76 | 1.01 | 1.66 | 1.06 | 0.88 | 0 | HGG 4 |
| 2734007 | 0.88 | 0.37 to 1.47 | 0.68 | 0.94 | 0.95 | 0.95 | 1.10 | 0.75 | 1.47 | 0.70 | 0.37 | 0 | HGG 4 |
| 2669871 | 1.03 | 0.71 to 1.42 | 1.42 | 1.21 | 0.94 | 1.09 | 1.23 | 1.04 | 0.91 | 0.75 | 0.71 | 0 | HGG 4 |
| 5101167 | 1.03 | 0.79 to 1.40 | 1.08 | 1.11 | 0.79 | 1.09 | 0.99 | 0.93 | 1.40 | 0.83 | 1.08 | 0 | HGG 4 |
| 5102951 | 0.85 | 0.68 to 1.33 | 0.78 | 0.82 | 0.69 | 0.78 | 0.91 | 0.83 | 1.33 | 0.79 | 0.68 | 0 | HGG 4 |
| 998615 | 0.91 | 0.60 to 1.42 | 0.93 | 0.99 | 0.60 | 0.97 | 0.69 | 0.81 | 1.42 | 0.94 | 0.86 | 0 | HGG 4 |
| 2013251 | 1.54 | 0.00 to 2.28 | 2.15 | 2.12 | 1.56 | 2.18 | 0.00 | 1.90 | 2.28 | 1.66 | 0.00 | 1 | HGG 4 |
| 1365045 | 1.89 | 1.62 to 2.35 | 1.95 | 2.02 | 1.62 | 1.97 | 1.80 | 1.78 | 2.35 | 1.72 | 1.79 | 1 | HGG 4 |
| 4077648 | 1.29 | 1.10 to 1.92 | 1.16 | 1.32 | 1.10 | 1.17 | 1.12 | 1.17 | 1.92 | 1.49 | 1.16 | 1 | HGG 4 |
| 2106010 | 1.53 | 1.23 to 2.09 | 1.62 | 1.73 | 1.23 | 1.65 | 1.23 | 1.35 | 2.09 | 1.50 | 1.37 | 1 | HGG 4 |
| 2110482 | 1.32 | 0.96 to 1.86 | 1.38 | 1.38 | 0.96 | 1.49 | 1.07 | 1.14 | 1.86 | 1.34 | 1.27 | 1 | HGG 4 |
| 2619275 | 1.34 | 1.12 to 1.84 | 1.40 | 1.47 | 1.13 | 1.38 | 1.20 | 1.25 | 1.84 | 1.30 | 1.12 | 1 | HGG 4 |
| 1913334 | 1.39 | 1.07 to 1.79 | 1.48 | 1.56 | 1.07 | 1.47 | 1.14 | 1.23 | 1.79 | 1.30 | 1.48 | 1 | HGG 4 |
| 3149570 | 1.19 | 0.00 to 1.75 | 1.48 | 1.40 | 1.05 | 1.47 | 0.00 | 1.17 | 1.75 | 1.32 | 1.05 | 1 | HGG 4 |
| 3016137 | 1.61 | 1.30 to 2.06 | 1.56 | 1.56 | 1.37 | 1.55 | 1.67 | 1.74 | 2.06 | 1.30 | 1.66 | 1 | HGG 4 |
| 2350594 | 1.37 | 1.04 to 1.82 | 1.58 | 1.65 | 1.19 | 1.36 | 1.09 | 1.06 | 1.82 | 1.50 | 1.04 | 1 | HGG 4 |
| 2408333 | 1.72 | 1.33 to 2.26 | 1.74 | 1.93 | 1.61 | 1.86 | 1.46 | 1.62 | 2.26 | 1.69 | 1.33 | 1 | HGG 4 |
| 439415 | 1.40 | 1.18 to 1.60 | 1.44 | 1.34 | 1.37 | 1.45 | 1.60 | 1.41 | 1.48 | 1.29 | 1.18 | 1 | HGG 4 |
| 1965856 | 1.41 | 1.12 to 1.85 | 1.52 | 1.55 | 1.12 | 1.67 | 1.12 | 1.29 | 1.85 | 1.33 | 1.26 | 1 | HGG 4 |

TABLE 11-continued

| | | | | | | | | | | | | | |
|---|---|---|---|---|---|---|---|---|---|---|---|---|---|
| 2006043 | 1.33 | 1.09 to 1.92 | 1.39 | 1.46 | 1.16 | 1.35 | 1.12 | 1.26 | 1.92 | 1.24 | 1.09 | 1 | HGG 4 |
| 5690026 | 1.29 | 0.97 to 1.92 | 1.39 | 1.39 | 0.97 | 1.57 | 1.00 | 1.02 | 1.92 | 1.29 | 1.03 | 1 | HGG 4 |
| 434751 | 1.62 | 1.37 to 1.92 | 1.81 | 1.75 | 1.37 | 1.78 | 1.43 | 1.44 | 1.92 | 1.44 | 1.62 | 1 | HGG 4 |
| 1872858 | 0.24 | −0.07 to 1.75 | −0.05 | 0.00 | 0.05 | 0.01 | 1.75 | −0.07 | 0.00 | 0.10 | 0.39 | 2 | HGG 4 |
| 2381040 | −0.18 | −1.96 to 0.36 | −1.96 | 0.00 | 0.00 | 0.00 | 0.00 | 0.00 | 0.00 | 0.36 | 0.00 | 2 | HGG 4 |
| 2415118 | 0.22 | 0.00 to 1.59 | 0.00 | 0.00 | 0.00 | 0.00 | 0.00 | 0.10 | 1.59 | 0.01 | 0.30 | 2 | HGG 4 |
| 5109437 | 0.01 | −0.29 to 1.43 | −0.20 | −0.16 | −0.20 | −0.29 | 0.00 | −0.25 | 1.43 | −0.23 | −0.01 | 2 | HGG 4 |
| 2759015 | 0.73 | 0.00 to 4.24 | 0.00 | 0.00 | 0.00 | 0.00 | 0.00 | 0.00 | 4.24 | 2.31 | 0.00 | 2 | HGG 4 |
| 5700537 | −0.16 | −1.40 to 0.00 | 0.00 | 0.00 | 0.00 | 0.00 | 0.00 | 0.00 | 0.00 | −1.40 | 0.00 | 2 | HGG 4 |
| 4223315 | 0.19 | 0.00 to 1.40 | 0.00 | 0.00 | 0.00 | 0.00 | 0.00 | 0.00 | 1.40 | 0.26 | 0.00 | 2 | HGG 4 |
| 2410066 | 0.99 | 0.00 to 1.47 | 1.47 | 1.35 | 1.09 | 1.40 | 0.00 | 1.29 | 0.00 | 1.24 | 1.09 | 3 | HGG 4 |
| 2405487 | 0.95 | 0.00 to 1.43 | 1.27 | 1.30 | 0.97 | 1.43 | 0.00 | 1.17 | 0.00 | 1.32 | 1.13 | 3 | HGG 4 |
| 3999352 | 0.71 | 0.00 to 3.77 | 3.77 | 1.73 | 0.00 | 0.48 | 0.00 | 0.00 | 0.00 | 0.28 | 0.13 | 3 | HGG 4 |
| 509839 | 1.22 | 0.00 to 1.88 | 1.88 | 1.86 | 1.27 | 1.87 | 0.00 | 1.40 | 0.00 | 1.49 | 1.18 | 3 | HGG 4 |
| 1951845 | 0.79 | 0.00 to 1.34 | 1.33 | 1.34 | 1.08 | 1.30 | 0.00 | 0.00 | 0.00 | 1.11 | 0.95 | 3 | HGG 4 |
| 2753371 | 0.52 | 0.00 to 4.09 | 0.00 | 4.09 | 0.00 | 0.00 | 0.00 | 0.00 | 0.00 | 0.58 | 0.00 | 3 | HGG 4 |
| 3522739 | 1.05 | 0.00 to 1.72 | 1.72 | 1.55 | 1.17 | 1.55 | 0.00 | 1.18 | 0.00 | 1.10 | 1.16 | 3 | HGG 4 |
| 5325802 | 0.27 | 0.00 to 2.00 | 0.00 | 0.00 | 0.00 | 2.00 | 0.00 | 0.00 | 0.00 | 0.40 | 0.00 | 4 | HGG 4 |
| 5859590 | −0.23 | −1.95 to 0.08 | 0.08 | 0.00 | −0.05 | 0.02 | −0.14 | −1.95 | 0.02 | −0.13 | 0.05 | 4 | HGG 4 |
| 198959 | 0.18 | −0.20 to 1.34 | 0.12 | 0.13 | 0.06 | 0.04 | 0.01 | 0.05 | 0.03 | 1.34 | −0.20 | 4 | HGG 4 |
| 1496011 | 0.51 | 0.00 to 1.47 | 1.47 | 0.00 | 0.00 | 1.43 | 0.00 | 0.00 | 0.00 | 0.95 | 0.71 | 4 | HGG 4 |
| 1329625 | 0.42 | 0.00 to 1.89 | 1.89 | 0.00 | 0.00 | 0.00 | 0.00 | 0.00 | 0.00 | 1.11 | 0.82 | 4 | HGG 4 |
| 2430165 | 0.23 | 0.00 to 1.33 | 0.00 | 0.00 | 0.00 | 0.00 | 0.00 | 0.00 | 0.00 | 0.74 | 1.33 | 4 | HGG 4 |
| 2267466 | 0.75 | 0.00 to 1.63 | 1.51 | 0.00 | 1.13 | 1.63 | 0.00 | 0.00 | 0.00 | 1.24 | 1.27 | 4 | HGG 4 |
| 2786442 | −1.49 | −1.85 to −1.15 | −1.85 | −1.62 | −1.20 | −1.76 | −1.29 | −1.41 | −1.77 | −1.32 | −1.15 | 5 | HGG 4 |
| 1857850 | −1.82 | −2.30 to −1.44 | −1.75 | −1.77 | −1.50 | −1.88 | −1.44 | −1.96 | −2.30 | −1.92 | −1.83 | 5 | HGG 4 |
| 3042227 | −1.57 | −2.05 to −1.17 | −1.63 | −1.72 | −1.17 | −1.67 | −1.25 | −1.58 | −2.05 | −1.64 | −1.41 | 5 | HGG 4 |
| 2055569 | −1.03 | −1.81 to −0.09 | −0.68 | −1.03 | −1.43 | −0.83 | −1.09 | −1.81 | −0.09 | −1.12 | −1.23 | 5 | HGG 4 |
| 495808 | −1.21 | −1.43 to −0.97 | −1.41 | −1.43 | −1.04 | −1.21 | −0.97 | −1.31 | −1.21 | −1.14 | −1.19 | 5 | HGG 4 |
| 1449819 | −1.70 | −2.63 to −0.59 | −0.96 | −2.16 | −2.27 | −0.75 | −2.07 | −2.63 | −0.59 | −2.38 | −1.49 | 5 | HGG 4 |
| 2581075 | 3.67 | 3.29 to 4.13 | 3.76 | 3.75 | 3.36 | 3.84 | 3.88 | 3.57 | 4.13 | 3.29 | 3.48 | 6 | HGG 4 |
| 1964758 | 2.25 | 1.86 to 2.81 | 2.41 | 2.43 | 1.86 | 2.56 | 2.00 | 2.04 | 2.81 | 2.15 | 2.04 | 6 | HGG 4 |
| 3191030 | 2.23 | 1.65 to 2.95 | 2.87 | 2.42 | 1.65 | 2.95 | 2.31 | 1.90 | 2.43 | 1.72 | 1.82 | 6 | HGG 4 |
| 2278772 | 2.68 | 2.05 to 3.37 | 2.90 | 2.71 | 2.21 | 2.91 | 2.28 | 3.04 | 3.37 | 2.63 | 2.05 | 6 | HGG 4 |
| 1370137 | 2.60 | 2.01 to 3.14 | 3.14 | 2.89 | 2.05 | 3.12 | 2.51 | 2.43 | 2.92 | 2.32 | 2.01 | 6 | HGG 4 |

TABLE 11

| Clone ID | Ave DE t/Prdsne | Range | mean DE t/Prdsne 1 μM, 1 hr | mean DE t/Prdsne 1 μM, 3 hr | mean DE t/Prdsne 1 μM, 6 hr | mean DE t/Prdsne 10 μM, 1 hr | mean DE t/Prdsne 10 μM, 3 hr | mean DE t/Prdsne 10 μM, 6 hr | mean DE t/Prdsne 100 μM, 1 hr | mean DE t/Prdsne 100 μM, 3 hr | mean DE t/Prdsne 100 μM, 6 hr | Cluster | GEM |
|---|---|---|---|---|---|---|---|---|---|---|---|---|---|
| 1910401 | −1.13 | −1.34 to −0.95 | −1.13 | −1.30 | −1.08 | −1.34 | −0.95 | −1.02 | −0.99 | −1.21 | −1.18 | 0 | HGG 1 |
| 3126622 | −1.07 | −1.37 to −0.80 | −1.11 | −1.17 | −0.80 | −1.00 | −1.02 | −1.06 | −1.37 | −1.05 | −1.04 | 0 | HGG 1 |
| 1740474 | −1.40 | −1.70 to −1.08 | −1.59 | −1.54 | −1.23 | −1.61 | −1.08 | −1.33 | −1.70 | −1.31 | −1.21 | 0 | HGG 1 |
| 3975209 | −1.49 | −1.81 to −1.21 | −1.65 | −1.41 | −1.48 | −1.81 | −1.30 | −1.46 | −1.70 | −1.21 | −1.40 | 0 | HGG 1 |
| 2769888 | −1.07 | −1.49 to −0.51 | −0.69 | −1.18 | −1.31 | −0.82 | −1.04 | −1.33 | −0.51 | −1.29 | −1.49 | 0 | HGG 1 |
| 3681722 | −1.15 | −1.45 to −0.94 | −1.36 | −1.45 | −1.06 | −1.25 | −0.94 | −1.09 | −1.09 | −1.05 | −1.11 | 0 | HGG 1 |
| 2471835 | −1.10 | −1.35 to −0.82 | −1.09 | −1.35 | −1.07 | −1.24 | −0.82 | −1.07 | −1.06 | −1.12 | −1.08 | 0 | HGG 1 |
| 3679667 | −1.29 | −1.50 to −1.15 | −1.19 | −1.21 | −1.19 | −1.36 | −1.28 | −1.26 | −1.15 | −1.50 | −1.49 | 0 | HGG 1 |
| 2767579 | −1.12 | −1.35 to −0.89 | −1.25 | −1.35 | −1.25 | −1.24 | −1.11 | −1.11 | −0.94 | −0.96 | −0.89 | 0 | HGG 1 |
| 1833362 | −0.92 | −1.39 to −0.48 | −0.86 | −1.13 | −0.48 | −0.91 | −0.78 | −0.71 | −0.87 | −1.13 | −1.39 | 0 | HGG 1 |
| 1840426 | −1.18 | −1.44 to −0.90 | −1.37 | −1.44 | −1.19 | −1.36 | −0.90 | −1.23 | −1.19 | −0.95 | −0.99 | 0 | HGG 1 |
| 1868536 | −1.42 | −1.58 to −1.23 | −1.23 | −1.36 | −1.39 | −1.54 | −1.35 | −1.50 | −1.35 | −1.46 | −1.58 | 0 | HGG 1 |
| 1596220 | −1.51 | −1.86 to −1.12 | −1.28 | −1.57 | −1.12 | −1.55 | −1.32 | −1.41 | −1.76 | −1.86 | −1.76 | 0 | HGG 1 |
| 1876456 | −1.46 | −1.66 to −1.17 | −1.48 | −1.66 | −1.17 | −1.56 | −1.30 | −1.33 | −1.65 | −1.53 | −1.49 | 0 | HGG 1 |
| 1890576 | −1.59 | −1.83 to −1.28 | −1.76 | −1.73 | −1.28 | −1.83 | −1.42 | −1.37 | −1.76 | −1.67 | −1.47 | 0 | HGG 1 |
| 1614014 | −0.81 | −1.37 to −0.27 | −0.99 | −1.00 | −0.27 | −0.93 | −0.56 | −0.66 | −1.37 | −0.95 | −0.60 | 0 | HGG 1 |
| 1619292 | −1.50 | −1.90 to −1.17 | −1.46 | −1.60 | −1.28 | −1.59 | −1.17 | −1.39 | −1.47 | −1.64 | −1.90 | 0 | HGG 1 |
| 3397390 | −1.15 | −1.50 to −0.78 | −0.97 | −1.25 | −1.18 | −1.07 | −1.09 | −1.27 | −0.78 | −1.26 | −1.50 | 0 | HGG 1 |

TABLE 12

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM 1 hr | mean DE t/Dex 100 μM 3 hr | mean DE t/Dex 100 μM 6 hr | Cluster | GEM |
|---|---|---|---|---|---|---|---|---|---|---|---|---|---|
| 1004382 | 1.24 | 0.99 to 1.64 | 1.64 | 1.02 | 1.11 | 1.25 | 1.63 | 1.07 | 1.01 | 0.99 | 1.47 | 0 | HGG 1 |
| 2823767 | 1.60 | 1.24 to 1.92 | 1.77 | 1.47 | 1.42 | 1.72 | 1.92 | 1.24 | 1.53 | 1.52 | 1.84 | 0 | HGG 1 |
| 2830240 | 1.05 | 0.74 to 1.67 | 1.09 | 0.74 | 0.93 | 1.13 | 1.67 | 0.96 | 0.76 | 0.75 | 1.45 | 0 | HGG 1 |
| 1241484 | 1.20 | 0.84 to 1.67 | 1.53 | 0.98 | 0.93 | 1.25 | 1.48 | 0.84 | 0.91 | 1.25 | 1.67 | 0 | HGG 1 |
| 1268277 | 0.89 | 0.56 to 1.33 | 1.19 | 0.81 | 0.56 | 0.91 | 1.14 | 0.58 | 0.61 | 0.86 | 1.33 | 0 | HGG 1 |
| 1275616 | 0.97 | 0.71 to 1.33 | 1.18 | 0.71 | 0.83 | 1.06 | 1.33 | 0.89 | 0.83 | 0.75 | 1.19 | 0 | HGG 1 |
| 1320685 | 1.65 | 1.35 to 2.00 | 1.89 | 1.43 | 1.43 | 1.68 | 2.00 | 1.35 | 1.56 | 1.61 | 1.90 | 0 | HGG 1 |
| 2070126 | 1.36 | 0.96 to 1.75 | 1.75 | 1.39 | 1.31 | 1.55 | 1.62 | 0.96 | 1.17 | 1.04 | 1.44 | 0 | HGG 1 |
| 1342744 | 1.34 | 0.98 to 1.77 | 1.77 | 1.25 | 1.03 | 1.38 | 1.68 | 0.98 | 1.21 | 1.28 | 1.52 | 0 | HGG 1 |
| 2833342 | 1.26 | 0.92 to 1.58 | 1.58 | 1.06 | 0.92 | 1.24 | 1.55 | 1.06 | 1.29 | 1.10 | 1.49 | 0 | HGG 1 |
| 3057272 | 0.98 | 0.71 to 1.39 | 1.18 | 1.00 | 0.71 | 0.88 | 1.07 | 0.81 | 0.79 | 0.96 | 1.39 | 0 | HGG 1 |
| 3068809 | 1.63 | 1.25 to 2.00 | 1.80 | 1.49 | 1.25 | 1.60 | 1.84 | 1.39 | 1.66 | 1.66 | 2.00 | 0 | HGG 1 |
| 143765 | 1.07 | 0.81 to 1.48 | 1.48 | 1.18 | 0.81 | 1.23 | 1.08 | 0.90 | 0.90 | 0.91 | 1.13 | 0 | HGG 1 |
| 3108506 | 0.82 | 0.42 to 1.47 | 0.95 | 0.60 | 0.42 | 0.67 | 0.98 | 0.53 | 0.75 | 0.97 | 1.47 | 0 | HGG 1 |
| 2120743 | 1.55 | 1.24 to 2.09 | 1.74 | 1.37 | 1.24 | 1.77 | 2.09 | 1.33 | 1.39 | 1.25 | 1.75 | 0 | HGG 1 |
| 1459743 | 1.51 | 1.05 to 1.93 | 1.78 | 1.41 | 1.25 | 1.59 | 1.73 | 1.05 | 1.33 | 1.47 | 1.93 | 0 | HGG 1 |
| 3381870 | 0.88 | 0.50 to 1.42 | 1.09 | 0.59 | 0.70 | 0.94 | 1.42 | 0.89 | 0.58 | 0.50 | 1.18 | 0 | HGG 1 |
| 2148703 | 1.01 | 0.56 to 1.54 | 1.00 | 0.56 | 0.82 | 1.09 | 1.54 | 1.09 | 0.80 | 0.75 | 1.39 | 0 | HGG 1 |
| 2173002 | 0.75 | 0.41 to 1.40 | 1.40 | 0.69 | 0.53 | 0.79 | 0.41 | 0.46 | 0.45 | 0.88 | 1.14 | 0 | HGG 1 |
| 1521272 | 1.08 | 0.75 to 1.58 | 1.58 | 1.11 | 0.98 | 1.10 | 1.29 | 0.75 | 0.79 | 0.90 | 1.23 | 0 | HGG 1 |
| 3497231 | 1.11 | 0.90 to 1.36 | 1.36 | 0.96 | 1.05 | 1.16 | 1.33 | 0.94 | 1.07 | 0.90 | 1.24 | 0 | HGG 1 |
| 1573840 | 0.86 | 0.39 to 1.37 | 1.20 | 0.71 | 0.63 | 1.13 | 1.37 | 0.39 | 0.72 | 0.54 | 1.06 | 0 | HGG 1 |
| 3595618 | 1.22 | 0.89 to 1.59 | 1.59 | 1.14 | 0.90 | 1.27 | 1.46 | 0.89 | 1.22 | 1.15 | 1.38 | 0 | HGG 1 |
| 3687719 | 1.01 | 0.62 to 1.53 | 1.53 | 0.93 | 0.62 | 0.94 | 1.23 | 0.73 | 0.92 | 1.00 | 1.21 | 0 | HGG 1 |
| 371201 | 1.50 | 1.21 to 1.91 | 1.39 | 1.27 | 1.21 | 1.45 | 1.91 | 1.37 | 1.58 | 1.57 | 1.77 | 0 | HGG 1 |
| 3818422 | 0.91 | 0.58 to 1.38 | 0.94 | 0.58 | 0.82 | 0.99 | 1.38 | 0.97 | 0.70 | 0.65 | 1.14 | 0 | HGG 1 |
| 3821432 | 1.27 | 0.98 to 1.61 | 1.61 | 1.15 | 0.99 | 1.35 | 1.60 | 0.98 | 1.15 | 1.12 | 1.46 | 0 | HGG 1 |
| 4018288 | 0.94 | 0.44 to 1.37 | 1.29 | 0.90 | 0.79 | 1.08 | 1.12 | 0.44 | 0.60 | 0.87 | 1.37 | 0 | HGG 1 |
| 2311213 | 1.13 | 0.85 to 1.42 | 1.39 | 1.19 | 0.91 | 1.01 | 1.23 | 0.92 | 0.85 | 1.21 | 1.42 | 0 | HGG 1 |
| 2313349 | 1.33 | 1.01 to 1.65 | 1.55 | 1.17 | 1.01 | 1.33 | 1.65 | 1.14 | 1.31 | 1.26 | 1.59 | 0 | HGG 1 |
| 4021009 | 1.16 | 0.91 to 1.49 | 1.49 | 1.01 | 1.00 | 1.15 | 1.43 | 0.92 | 0.91 | 1.11 | 1.43 | 0 | HGG 1 |
| 2445967 | 1.14 | 0.82 to 1.64 | 1.64 | 1.02 | 0.82 | 1.17 | 1.45 | 0.92 | 1.02 | 0.99 | 1.23 | 0 | HGG 1 |
| 419492 | 1.08 | 0.79 to 1.47 | 1.17 | 0.94 | 0.79 | 0.97 | 1.25 | 0.96 | 1.05 | 1.08 | 1.47 | 0 | HGG 1 |
| 2459765 | 1.07 | 0.78 to 1.33 | 1.31 | 0.93 | 0.78 | 1.05 | 1.33 | 0.84 | 1.08 | 1.03 | 1.27 | 0 | HGG 1 |
| 4377432 | 0.87 | 0.51 to 1.45 | 1.08 | 0.52 | 0.67 | 0.98 | 1.45 | 0.91 | 0.64 | 0.51 | 1.11 | 0 | HGG 1 |
| 494905 | 0.75 | 0.43 to 1.33 | 0.68 | 0.65 | 0.70 | 1.11 | 1.33 | 0.43 | 0.57 | 0.56 | 0.68 | 0 | HGG 1 |
| 5046235 | 1.17 | 0.91 to 1.70 | 1.11 | 0.91 | 0.92 | 1.05 | 1.40 | 1.03 | 1.08 | 1.31 | 1.70 | 0 | HGG 1 |
| 2504870 | 1.02 | 0.67 to 1.64 | 1.36 | 0.71 | 0.73 | 1.25 | 1.64 | 0.90 | 0.91 | 0.67 | 1.03 | 0 | HGG 1 |
| 5098879 | 0.91 | 0.39 to 1.43 | 1.43 | 0.92 | 0.74 | 0.98 | 1.15 | 0.39 | 0.45 | 0.89 | 1.23 | 0 | HGG 1 |
| 2511277 | 1.45 | 1.05 to 1.95 | 1.40 | 1.05 | 1.19 | 1.56 | 1.79 | 1.17 | 1.36 | 1.61 | 1.95 | 0 | HGG 1 |
| 2516950 | 1.47 | 1.11 to 1.93 | 1.93 | 1.41 | 1.25 | 1.49 | 1.78 | 1.11 | 1.25 | 1.35 | 1.67 | 0 | HGG 1 |
| 1956982 | 1.13 | 0.94 to 1.51 | 1.51 | 1.28 | 0.96 | 1.24 | 1.12 | 0.94 | 1.13 | 0.97 | 1.04 | 0 | HGG 1 |
| 531505 | 0.96 | 0.68 to 1.39 | 1.39 | 0.96 | 0.68 | 0.91 | 0.91 | 0.68 | 0.83 | 1.07 | 1.23 | 0 | HGG 1 |

TABLE 12-continued

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM, 1 hr | mean DE t/Dex 100 μM, 3 hr | mean DE t/Dex 100 μM, 6 hr | Cluster | GEM |
|---|---|---|---|---|---|---|---|---|---|---|---|---|---|
| 671717 | 1.39 | 1.13 to 1.83 | 1.83 | 1.22 | 1.24 | 1.37 | 1.58 | 1.18 | 1.13 | 1.19 | 1.81 | 0 | HGG 1 |
| 2697275 | 1.31 | 1.10 to 1.60 | 1.54 | 1.10 | 1.15 | 1.35 | 1.60 | 1.16 | 1.17 | 1.19 | 1.58 | 0 | HGG 1 |
| 2756333 | 1.35 | 1.00 to 1.79 | 1.59 | 1.12 | 1.09 | 1.35 | 1.71 | 1.06 | 1.00 | 1.40 | 1.79 | 0 | HGG 1 |
| 2778441 | 1.31 | 1.02 to 1.59 | 1.59 | 1.22 | 1.05 | 1.32 | 1.55 | 1.02 | 1.27 | 1.19 | 1.54 | 0 | HGG 1 |
| 279898 | 0.87 | −0.25 to 1.64 | 0.02 | 1.10 | 1.53 | −0.08 | 1.64 | 1.24 | −0.25 | 1.04 | 1.63 | 0 | HGG 1 |
| 2822027 | 0.82 | 0.42 to 1.33 | 1.11 | 0.72 | 0.60 | 1.01 | 1.33 | 0.60 | 0.66 | 0.42 | 0.95 | 0 | HGG 1 |
| 509758 | −1.16 | −1.34 to −0.90 | −1.32 | −1.34 | −1.24 | −1.24 | −1.30 | −0.90 | −0.90 | −1.03 | −1.22 | 1 | HGG 1 |
| 1235535 | −1.12 | −1.32 to −0.98 | −1.23 | −1.32 | −1.11 | −1.07 | −0.98 | −1.07 | −1.03 | −1.11 | −1.14 | 1 | HGG 1 |
| 1331853 | −1.16 | −1.54 to −0.81 | −1.54 | −1.40 | −1.21 | −1.07 | −0.81 | −1.09 | −1.02 | −1.13 | −1.13 | 1 | HGG 1 |
| 2132606 | −1.23 | −1.56 to −1.01 | −1.52 | −1.26 | −1.01 | −1.20 | −1.56 | −1.08 | −1.12 | −1.06 | −1.27 | 1 | HGG 1 |
| 4698018 | −1.12 | −1.35 to −0.84 | −1.35 | −1.16 | −0.99 | −1.16 | −1.09 | −0.95 | −0.84 | −1.19 | −1.31 | 1 | HGG 1 |
| 2095144 | −1.24 | −1.42 to −1.05 | −1.42 | −1.26 | −1.20 | −1.23 | −1.42 | −1.08 | −1.11 | −1.05 | −1.42 | 1 | HGG 1 |
| 1441245 | −1.25 | −1.48 to −0.80 | −1.45 | −1.21 | −1.11 | −1.48 | −1.44 | −0.87 | −0.80 | −1.36 | −1.45 | 1 | HGG 1 |
| 2769888 | −1.21 | −1.56 to −0.67 | −0.67 | −1.41 | −1.56 | −0.83 | −1.26 | −1.45 | −0.81 | −1.44 | −1.47 | 1 | HGG 1 |
| 167081 | −1.10 | −1.52 to −0.40 | −1.39 | −1.15 | −1.13 | −0.81 | −0.40 | −1.52 | −1.18 | −1.14 | −1.20 | 1 | HGG 1 |
| 2252884 | −1.19 | −1.38 to −0.97 | −1.32 | −1.29 | −1.16 | −1.15 | −1.31 | −0.99 | −1.10 | −0.97 | −1.38 | 1 | HGG 1 |
| 1501410 | −1.16 | −1.38 to −0.92 | −1.06 | −1.31 | −1.38 | −1.18 | −1.09 | −1.13 | −0.92 | −1.18 | −1.21 | 1 | HGG 1 |
| 2285521 | −1.22 | −1.47 to −1.03 | −1.47 | −1.30 | −1.11 | −1.23 | −1.42 | −1.05 | −1.08 | −1.03 | −1.27 | 1 | HGG 1 |
| 2287724 | −1.16 | −1.50 to −0.90 | −1.50 | −1.24 | −1.04 | −1.23 | −1.32 | −0.90 | −0.95 | −0.95 | −1.28 | 1 | HGG 1 |
| 1840426 | −1.15 | −1.55 to −0.87 | −1.29 | −1.25 | −0.87 | −1.33 | −1.55 | −0.95 | −0.90 | −0.91 | −1.32 | 1 | HGG 1 |
| 2623304 | −1.18 | −1.47 to −0.92 | −1.15 | −1.47 | −1.27 | −1.29 | −1.07 | −0.92 | −0.97 | −1.25 | −1.21 | 1 | HGG 1 |
| 1910401 | −1.16 | −1.46 to −0.22 | −1.35 | −1.46 | −1.30 | −1.28 | −1.16 | −1.03 | −0.22 | −1.24 | −1.38 | 1 | HGG 1 |
| 2495131 | −1.25 | −1.55 to −0.71 | −1.55 | −1.46 | −1.25 | −1.20 | −0.71 | −1.45 | −1.09 | −1.16 | −1.40 | 1 | HGG 1 |
| 3397390 | −1.32 | −1.57 to −1.06 | −1.09 | −1.47 | −1.57 | −1.34 | −1.06 | −1.45 | −1.40 | −1.25 | −1.30 | 1 | HGG 1 |
| 2767579 | −1.20 | −1.32 to −1.04 | −1.32 | −1.23 | −1.11 | −1.23 | −1.24 | −1.08 | −1.04 | −1.25 | −1.32 | 1 | HGG 1 |
| 2055814 | −1.17 | −1.55 to −0.84 | −0.84 | −1.16 | −1.19 | −1.16 | −1.26 | −1.01 | −1.03 | −1.38 | | 1 | HGG 1 |
| 4884214 | −0.77 | −1.40 to −0.48 | −0.95 | −0.48 | −0.53 | −0.73 | −1.40 | −0.63 | −0.69 | −0.65 | −0.85 | 2 | HGG 1 |
| 4284270 | −0.88 | −1.36 to −0.37 | −0.98 | −1.01 | −0.94 | −0.99 | −1.36 | −0.67 | −0.37 | −0.68 | −0.89 | 2 | HGG 1 |
| 2293496 | −0.82 | −1.40 to −0.43 | −0.43 | −0.80 | −0.81 | −0.64 | −1.40 | −0.84 | −0.50 | −0.88 | −1.07 | 2 | HGG 1 |
| 4089291 | −0.77 | −1.39 to −0.55 | −0.65 | −0.84 | −0.65 | −0.81 | −1.39 | −0.60 | −0.55 | −0.62 | −0.85 | 2 | HGG 1 |
| 3686603 | −0.86 | −1.38 to −0.44 | −0.94 | −0.86 | −0.65 | −1.18 | −1.38 | −0.44 | −0.71 | −0.85 | −0.72 | 2 | HGG 1 |
| 2850323 | −0.76 | −1.54 to −0.47 | −0.80 | −0.74 | −0.67 | −0.84 | −1.54 | −0.51 | −0.50 | −0.47 | −0.73 | 2 | HGG 1 |
| 3451645 | −1.03 | −1.92 to −0.64 | −0.74 | −1.01 | −0.99 | −1.05 | −1.92 | −1.07 | −0.64 | −0.86 | −1.00 | 2 | HGG 1 |
| 2946292 | −0.87 | −1.40 to −0.64 | −0.78 | −0.64 | −0.80 | −0.89 | −1.40 | −0.77 | −0.91 | −0.72 | −0.90 | 2 | HGG 1 |
| 1614014 | −0.90 | −1.50 to −0.48 | −1.26 | −0.89 | −0.48 | −1.20 | −1.50 | −0.59 | −0.76 | −0.66 | −0.81 | 2 | HGG 1 |
| 2239236 | −0.74 | −1.40 to −0.39 | −0.75 | −0.71 | −0.39 | −1.03 | −1.40 | −0.42 | −0.72 | −0.56 | −0.67 | 2 | HGG 1 |
| 1652328 | −0.93 | −1.59 to −0.56 | −0.88 | −0.81 | −0.79 | −1.17 | −1.59 | −0.74 | −0.56 | −0.79 | −1.00 | 2 | HGG 1 |
| 1979756 | −1.06 | −1.61 to −0.83 | −1.25 | −0.95 | −0.83 | −1.15 | −1.61 | −0.88 | −0.87 | −0.94 | −1.07 | 2 | HGG 1 |
| 3139631 | −0.82 | −1.57 to −0.56 | −0.83 | −0.76 | −0.75 | −0.85 | −0.57 | −0.58 | −0.56 | −0.63 | −0.84 | 2 | HGG 1 |
| 5506170 | −0.74 | −1.39 to −0.29 | −0.29 | −0.81 | −0.69 | −0.70 | −1.39 | −0.65 | −0.34 | −0.82 | −0.94 | 2 | HGG 1 |
| 1667220 | −0.97 | −1.45 to −0.63 | −1.17 | −1.08 | −0.79 | −1.21 | −1.45 | −0.63 | −0.69 | −0.86 | −0.85 | 2 | HGG 1 |
| 380006 | −0.98 | −1.41 to −0.63 | −1.06 | −0.88 | −0.87 | −1.22 | −1.41 | −0.81 | −0.63 | −0.80 | −1.16 | 2 | HGG 1 |
| 2055867 | −0.70 | −1.33 to −0.02 | −0.09 | −1.33 | −0.91 | −0.20 | −1.15 | −0.77 | −0.02 | −0.95 | −0.87 | 2 | HGG 1 |
| 459372 | 2.04 | 1.72 to 2.37 | 2.29 | 2.06 | 1.76 | 2.06 | 2.37 | 2.00 | 1.94 | 1.72 | 2.13 | 3 | HGG 1 |
| 2755836 | 3.41 | 2.62 to 4.02 | 3.89 | 3.26 | 2.62 | 3.35 | 3.89 | 3.33 | 3.14 | 3.17 | 4.02 | 3 | HGG 1 |
| 548114 | 2.00 | 1.70 to 2.39 | 2.06 | 1.80 | 1.70 | 2.12 | 2.39 | 2.05 | 1.96 | 1.86 | 2.09 | 3 | HGG 1 |
| 5501676 | 1.79 | 0.00 to 3.22 | 3.22 | 2.66 | 1.99 | 2.96 | 0.00 | 0.00 | 2.32 | 0.00 | 2.99 | 3 | HGG 1 |
| 1457424 | 2.10 | 1.68 to 2.64 | 2.64 | 2.26 | 1.82 | 2.19 | 2.34 | 1.68 | 1.89 | 1.79 | 2.25 | 3 | HGG 1 |
| 617587 | 1.99 | 0.00 to 2.83 | 2.43 | 2.22 | 2.04 | 2.44 | 0.00 | 1.92 | 1.70 | 2.30 | 2.83 | 3 | HGG 1 |
| 2494284 | 1.87 | 1.58 to 2.24 | 1.86 | 1.58 | 1.94 | 1.83 | 2.24 | 1.78 | 1.69 | 1.74 | 2.12 | 3 | HGG 1 |
| 2520894 | 2.34 | 1.93 to 2.76 | 2.65 | 2.19 | 2.13 | 2.46 | 2.66 | 1.93 | 1.93 | 2.36 | 2.76 | 3 | HGG 1 |
| 2818476 | 2.59 | 0.00 to 3.84 | 3.84 | 3.02 | 2.25 | 2.95 | 0.00 | 2.71 | 2.59 | 2.49 | 3.47 | 3 | HGG 1 |
| 3606046 | 1.78 | 1.35 to 2.15 | 2.15 | 1.60 | 1.49 | 1.89 | 2.12 | 1.35 | 1.52 | 1.74 | 2.15 | 3 | HGG 1 |
| 1630990 | 2.73 | 2.13 to 3.40 | 3.40 | 2.49 | 2.13 | 2.84 | 2.91 | 2.42 | 2.69 | 2.51 | 3.16 | 3 | HGG 1 |
| 1684617 | 1.89 | 1.28 to 2.42 | 2.42 | 1.95 | 1.75 | 2.00 | 2.17 | 1.40 | 1.28 | 1.81 | 2.27 | 3 | HGG 1 |
| 3792988 | 1.99 | 1.43 to 2.51 | 2.38 | 1.96 | 1.70 | 2.13 | 2.23 | 1.43 | 1.54 | 2.01 | 2.51 | 3 | HGG 1 |
| 2956444 | 1.68 | 1.00 to 2.23 | 2.23 | 1.74 | 1.57 | 1.98 | 1.85 | 1.00 | 1.35 | 1.47 | 1.96 | 3 | HGG 1 |
| 4287327 | 2.15 | 1.54 to 2.65 | 2.05 | 2.18 | 2.22 | 2.03 | 2.45 | 1.54 | 1.91 | 2.65 | 2.33 | 3 | HGG 1 |
| 4549259 | 2.99 | 2.57 to 3.42 | 3.33 | 2.95 | 2.70 | 3.19 | 3.42 | 2.57 | 2.81 | 2.63 | 3.26 | 3 | HGG 1 |
| 1210839 | 1.32 | 0.00 to 1.91 | 1.91 | 1.30 | 1.31 | 1.67 | 0.00 | 1.39 | 1.32 | 1.29 | 1.72 | 4 | HGG 1 |
| 136073 | 0.89 | 0.00 to 1.70 | 1.70 | 1.26 | 0.95 | 1.08 | 0.00 | 0.91 | 1.14 | 0.99 | 0.00 | 4 | HGG 1 |
| 2061171 | 0.79 | 0.00 to 1.36 | 0.00 | 1.11 | 1.03 | 1.06 | 0.00 | 0.90 | 0.86 | 0.83 | 1.36 | 4 | HGG 1 |
| 139949 | 1.06 | 0.00 to 1.59 | 1.59 | 1.21 | 1.23 | 1.27 | 0.00 | 0.84 | 0.99 | 1.09 | 1.29 | 4 | HGG 1 |
| 4554722 | 0.94 | 0.00 to 1.77 | 1.28 | 0.93 | 0.76 | 0.98 | 0.00 | 0.70 | 0.78 | 1.26 | 1.77 | 4 | HGG 1 |
| 1944123 | 0.94 | 0.00 to 1.41 | 1.32 | 1.13 | 0.76 | 1.04 | 0.00 | 0.83 | 0.94 | 1.00 | 1.41 | 4 | HGG 1 |
| 1560906 | 1.25 | 0.00 to 2.31 | 2.31 | 1.37 | 1.22 | 1.70 | 0.00 | 0.90 | 0.86 | 1.17 | 1.70 | 4 | HGG 1 |
| 2403438 | 1.58 | 0.00 to 2.29 | 2.29 | 1.78 | 1.70 | 1.84 | 0.00 | 1.46 | 1.49 | 1.62 | 2.07 | 4 | HGG 1 |
| 4286760 | 1.08 | −0.04 to 1.41 | 1.26 | 1.28 | 1.41 | 0.63 | −0.04 | 1.33 | 1.30 | 1.23 | 1.36 | 4 | HGG 1 |
| 2110430 | 1.62 | 0.00 to 2.41 | 2.41 | 1.97 | 1.63 | 1.98 | 0.00 | 1.35 | 1.51 | 1.58 | 2.10 | 4 | HGG 1 |
| 4092112 | 0.92 | 0.00 to 1.59 | 1.59 | 1.45 | 1.16 | 1.25 | 0.00 | 0.91 | 1.08 | 0.86 | 0.00 | 4 | HGG 1 |
| 1756875 | 1.28 | 0.00 to 1.86 | 1.73 | 1.38 | 1.32 | 1.66 | 0.00 | 1.05 | 1.09 | 1.39 | 1.86 | 4 | HGG 1 |
| 3391835 | 0.92 | 0.00 to 2.68 | 2.68 | 2.09 | 1.75 | 0.00 | 0.00 | 0.00 | 1.78 | 0.00 | 0.00 | 4 | HGG 1 |
| 5509134 | 1.60 | 0.00 to 2.30 | 2.30 | 1.57 | 1.41 | 1.68 | 0.00 | 1.73 | 1.86 | 1.62 | 2.20 | 4 | HGG 1 |

TABLE 12-continued

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM, 1 hr | mean DE t/Dex 100 μM, 3 hr | mean DE t/Dex 100 μM, 6 hr | Cluster | GEM |
|---|---|---|---|---|---|---|---|---|---|---|---|---|---|
| 305751 | 1.46 | 0.00 to 1.92 | 1.86 | 1.47 | 1.33 | 1.64 | 0.00 | 1.53 | 1.77 | 1.58 | 1.92 | 4 | HGG 1 |
| 2506973 | −1.62 | −2.00 to −1.33 | −1.90 | −1.65 | −1.45 | −1.88 | −2.00 | −1.33 | −1.39 | −1.37 | −1.62 | 5 | HGG 1 |
| 3001212 | −1.49 | −2.25 to −1.06 | −1.82 | −1.47 | −1.22 | −1.97 | −2.25 | −1.06 | −1.16 | −1.17 | −1.35 | 5 | HGG 1 |
| 41479 | −1.38 | −2.35 to −1.14 | −1.32 | −1.30 | −1.14 | −1.40 | −2.35 | −1.20 | −1.16 | −1.16 | −1.39 | 5 | HGG 1 |
| 2471835 | −1.39 | −1.82 to −1.19 | −1.82 | −1.54 | −1.33 | −1.40 | −1.20 | −1.19 | −1.20 | −1.25 | −1.60 | 5 | HGG 1 |
| 2061528 | −1.52 | −1.78 to −1.18 | −1.68 | −1.71 | −1.49 | −1.78 | −1.45 | −1.18 | −1.41 | −1.37 | −1.59 | 5 | HGG 1 |
| 508943 | −1.26 | −1.56 to −0.97 | −1.56 | −1.25 | −1.24 | −1.53 | −1.54 | −1.02 | −0.97 | −1.04 | −1.22 | 5 | HGG 1 |
| 5291518 | −1.46 | −1.60 to −1.31 | −1.40 | −1.60 | −1.57 | −1.47 | −1.44 | −1.44 | −1.31 | −1.52 | −1.42 | 5 | HGG 1 |
| 1868536 | −1.43 | −1.76 to −1.03 | −1.56 | −1.43 | −1.44 | −1.60 | −1.76 | −1.20 | −1.03 | −1.23 | −1.61 | 5 | HGG 1 |
| 1876456 | −1.55 | −1.86 to −1.21 | −1.86 | −1.63 | −1.36 | −1.80 | −1.84 | −1.21 | −1.39 | −1.28 | −1.59 | 5 | HGG 1 |
| 3126622 | −1.25 | −2.00 to −0.95 | −1.33 | −1.23 | −0.97 | −1.44 | −2.00 | −1.17 | −0.95 | −0.96 | −1.21 | 5 | HGG 1 |
| 3679667 | −1.54 | −1.81 to −1.25 | −1.47 | −1.78 | −1.57 | −1.46 | −1.42 | −1.34 | −1.25 | −1.74 | −1.81 | 5 | HGG 1 |
| 2047730 | −1.42 | −1.88 to −1.02 | −1.46 | −1.30 | −1.34 | −1.61 | −1.88 | −1.33 | −1.17 | −1.02 | −1.67 | 5 | HGG 1 |
| 3681722 | −1.40 | −1.64 to −1.12 | −1.64 | −1.49 | −1.16 | −1.57 | −1.62 | −1.12 | −1.38 | −1.15 | −1.52 | 5 | HGG 1 |
| 293477 | −1.35 | −1.76 to −1.11 | −1.76 | −1.51 | −1.28 | −1.38 | −1.21 | −1.11 | −1.16 | −1.19 | −1.54 | 5 | HGG 1 |
| 891072 | −1.31 | −1.61 to −0.91 | −1.31 | −1.45 | −1.24 | −1.50 | −1.61 | −0.91 | −1.08 | −1.21 | −1.48 | 5 | HGG 1 |
| 4408943 | −1.68 | −1.90 to −1.25 | −1.62 | −1.90 | −1.79 | −1.79 | −1.73 | −1.49 | −1.25 | −1.70 | −1.79 | 6 | HGG 1 |
| 3031022 | −1.83 | −2.06 to −1.57 | −1.83 | −1.95 | −1.75 | −1.75 | −1.97 | −1.73 | −1.57 | −1.84 | −2.06 | 6 | HGG 1 |
| 2042056 | −1.96 | −2.38 to −1.55 | −2.05 | −2.38 | −1.86 | −2.29 | −1.86 | −1.72 | −1.86 | −2.10 | −1.55 | 6 | HGG 1 |
| 1596220 | −1.66 | −1.99 to −1.42 | −1.72 | −1.66 | −1.45 | −1.91 | −1.99 | −1.42 | −1.50 | −1.45 | −1.84 | 6 | HGG 1 |
| 1619292 | −1.67 | −2.03 to −1.35 | −2.03 | −1.78 | −1.72 | −1.61 | −1.43 | −1.65 | −1.59 | −1.35 | −1.89 | 6 | HGG 1 |
| 5047895 | −1.79 | −1.99 to −1.49 | −1.72 | −1.97 | −1.98 | −1.99 | −1.73 | −1.55 | −1.49 | −1.84 | −1.87 | 6 | HGG 1 |
| 1740474 | −1.67 | −2.25 to −1.37 | −1.75 | −1.64 | −1.43 | −1.73 | −2.25 | −1.54 | −1.64 | −1.37 | −1.68 | 6 | HGG 1 |
| 2886955 | −1.91 | −2.24 to −1.69 | −2.13 | −2.05 | −1.73 | −2.00 | −1.90 | −1.76 | −1.69 | −1.69 | −2.24 | 6 | HGG 1 |
| 1890576 | −1.77 | −2.36 to −1.33 | −2.36 | −1.83 | −1.69 | −1.74 | −1.33 | −1.80 | −1.52 | −1.60 | −2.06 | 6 | HGG 1 |
| 3975209 | −1.66 | −2.07 to −1.23 | −2.07 | −1.66 | −1.66 | −1.92 | −1.76 | −1.56 | −1.49 | −1.23 | −1.92 | 6 | HGG 1 |
| 2912637 | −2.28 | −2.82 to −1.98 | −2.82 | −2.24 | −1.98 | −2.53 | −2.42 | −2.05 | −2.13 | −1.98 | −2.39 | 6 | HGG 1 |
| 5541828 | −2.05 | −2.48 to −1.56 | −2.04 | −2.10 | −2.19 | −2.22 | −2.38 | −1.62 | −1.56 | −1.82 | −2.48 | 6 | HGG 1 |
| 560115 | −2.00 | −2.59 to −1.50 | −1.50 | −2.59 | −2.10 | −2.02 | −2.28 | −1.70 | −1.74 | −2.32 | −1.72 | 6 | HGG 1 |
| 2095268 | −1.00 | −1.42 to −0.76 | −1.42 | −1.07 | −0.84 | −0.99 | −1.17 | −0.76 | −0.83 | −0.82 | −1.14 | 7 | HGG 1 |
| 4246966 | −1.07 | −1.42 to −0.76 | −1.23 | −1.42 | −0.86 | −1.18 | −0.97 | −0.76 | −0.97 | −1.35 | −0.89 | 7 | HGG 1 |
| 2060823 | −1.09 | −1.58 to −0.69 | −1.58 | −1.08 | −0.97 | −1.12 | −0.69 | −0.99 | −1.14 | −0.93 | −1.33 | 7 | HGG 1 |
| 2051966 | −1.04 | −1.56 to −0.74 | −1.56 | −1.24 | −0.86 | −1.04 | −1.18 | −0.74 | −0.78 | −0.76 | −1.15 | 7 | HGG 1 |
| 1886928 | −0.60 | −1.40 to 0.00 | −1.40 | −0.73 | −0.69 | −0.81 | 0.00 | −0.52 | 0.00 | −0.71 | −0.51 | 7 | HGG 1 |
| 5198045 | −0.95 | −1.39 to −0.61 | −1.39 | −1.25 | −0.92 | −0.91 | −1.85 | −0.61 | −0.82 | −0.87 | −0.92 | 7 | HGG 1 |
| 3747901 | −0.99 | −1.42 to −0.75 | −1.42 | −1.26 | −0.88 | −1.05 | −0.85 | −0.76 | −0.75 | −0.94 | −1.04 | 7 | HGG 1 |
| 3973887 | −1.06 | −1.48 to −0.73 | −1.48 | −1.39 | −1.03 | −1.15 | −0.73 | −0.85 | −0.85 | −1.07 | −0.97 | 7 | HGG 1 |
| 2458526 | −0.89 | −1.40 to −0.54 | −1.40 | −1.05 | −0.83 | −0.93 | −0.67 | −0.71 | −0.54 | −0.83 | −1.02 | 7 | HGG 1 |
| 2947188 | −0.98 | −1.33 to −0.71 | −1.27 | −1.02 | −0.71 | −1.26 | −1.33 | −1.75 | −0.85 | −0.71 | −0.93 | 7 | HGG 1 |
| 223436 | −0.97 | −1.33 to −0.75 | −1.33 | −1.10 | −0.85 | −0.94 | −1.04 | −0.85 | −0.83 | −0.75 | −1.04 | 7 | HGG 1 |
| 2095728 | −1.01 | −1.33 to −0.80 | −1.33 | −1.03 | −0.89 | −1.16 | −0.99 | −0.80 | −0.89 | −0.93 | −1.05 | 7 | HGG 1 |
| 1366040 | 0.15 | 0.00 to 1.35 | 0.00 | 0.00 | 1.35 | 0.00 | 0.00 | 0.00 | 0.00 | 0.00 | 0.00 | 8 | HGG 1 |
| 1478855 | −0.19 | −1.67 to 0.00 | 0.00 | 0.00 | 0.00 | 0.00 | 0.00 | −1.67 | 0.00 | 0.00 | 0.00 | 8 | HGG 1 |
| 3187903 | 0.22 | 0.00 to 2.00 | 0.00 | 0.00 | 0.01 | 0.00 | 0.00 | 0.00 | 0.00 | 2.00 | 0.00 | 8 | HGG 1 |
| 1700074 | 0.45 | −0.16 to 1.39 | 0.35 | 0.31 | 1.39 | −0.06 | −0.16 | 0.89 | 0.21 | 0.18 | 0.94 | 8 | HGG 1 |
| 5374705 | 0.33 | 0.00 to 2.71 | 0.00 | 0.00 | 0.30 | 0.00 | 2.71 | 0.00 | 0.00 | 0.00 | 0.00 | 8 | HGG 1 |
| 3566941 | 0.24 | 0.00 to 1.62 | 0.00 | 0.00 | 0.50 | 0.00 | 1.62 | 0.00 | 0.00 | 0.00 | 0.00 | 8 | HGG 1 |
| 1500810 | −0.70 | −1.58 to −0.38 | −0.85 | −0.71 | −0.40 | −0.88 | −1.58 | −0.38 | −0.38 | −0.44 | −0.74 | 9 | HGG 1 |
| 1930847 | −0.67 | −1.74 to −0.29 | −0.75 | −0.55 | −0.40 | −0.98 | −1.74 | −0.29 | −0.36 | −0.39 | −0.58 | 9 | HGG 1 |
| 41247 | −0.34 | −1.42 to 0.12 | −0.25 | −0.31 | −0.22 | −0.29 | −1.42 | −0.01 | 0.12 | −0.25 | −0.37 | 9 | HGG 1 |
| 526319 | −0.49 | −1.33 to −0.03 | −0.03 | −0.40 | −0.37 | −0.56 | −1.33 | −0.48 | −0.25 | −0.41 | −0.52 | 9 | HGG 1 |
| 2273944 | −0.45 | −1.36 to −0.14 | −0.33 | −0.26 | −0.29 | −0.72 | −1.36 | −0.14 | −0.18 | −0.51 | −0.26 | 9 | HGG 1 |
| | | 0.00 to 0.00 | | | | | | | | | | | |
| | | 0.00 to 0.00 | | | | | | | | | | | |
| 2287426 | −1.16 | −1.46 to −0.89 | −1.46 | −1.23 | −1.07 | −1.26 | −1.17 | −1.04 | −0.89 | −1.19 | | 0 | HGG 2 |
| 2287703 | −1.24 | −1.51 to −1.05 | −1.51 | −1.36 | −1.18 | −1.31 | −1.05 | −1.08 | −1.07 | −1.34 | | 0 | HGG 2 |
| 2345426 | −1.08 | −1.49 to −0.67 | −1.49 | −1.28 | −0.76 | −1.32 | −0.67 | −1.18 | −1.04 | −0.91 | | 0 | HGG 2 |
| 2453558 | −1.32 | −1.42 to −1.13 | −1.41 | −1.38 | −1.13 | −1.42 | −1.34 | −1.30 | −1.24 | −1.39 | | 0 | HGG 2 |
| 2469891 | −1.56 | −1.88 to −1.35 | −1.88 | −1.57 | −1.64 | −1.47 | −1.52 | −1.45 | −1.35 | −1.59 | | 0 | HGG 2 |
| 1437552 | −1.15 | −1.48 to −0.72 | −1.48 | −1.14 | −1.27 | −1.45 | −0.72 | −0.99 | −1.02 | −1.16 | | 0 | HGG 2 |
| 2055279 | −1.21 | −1.42 to −1.00 | −1.42 | −1.28 | −1.12 | −1.29 | −1.34 | −1.04 | −1.00 | −1.18 | | 0 | HGG 2 |
| 2703122 | −1.66 | −1.84 to −1.54 | −1.04 | −1.55 | −1.66 | −1.76 | −1.66 | −1.54 | −1.58 | −1.84 | | 0 | HGG 2 |
| 2086783 | −1.18 | −1.50 to −0.90 | −1.50 | −1.33 | −1.16 | −1.29 | −1.00 | −1.05 | −0.90 | −1.25 | | 0 | HGG 2 |
| 2088104 | −1.20 | −1.58 to −0.88 | −1.58 | −1.32 | −1.15 | −1.31 | −1.21 | −0.91 | −0.88 | −1.22 | | 0 | HGG 2 |
| 2089176 | −1.10 | −1.42 to −0.83 | −1.42 | −1.34 | −0.99 | −1.18 | −1.01 | −0.87 | −0.83 | −1.15 | | 0 | HGG 2 |
| 2095329 | −1.37 | −1.68 to −1.15 | −1.68 | −1.50 | −1.32 | −1.46 | −1.20 | −1.15 | −1.18 | −1.50 | | 0 | HGG 2 |
| 2954059 | −1.22 | −1.71 to −0.98 | −1.71 | −1.37 | −1.11 | −1.37 | −1.02 | −1.08 | −1.14 | −0.98 | | 0 | HGG 2 |
| 3115505 | −1.10 | −1.42 to −0.86 | −1.42 | −1.26 | −1.03 | −1.27 | −0.86 | −0.97 | −0.99 | −1.05 | | 0 | HGG 2 |
| 2253868 | −1.07 | −1.53 to −0.70 | −1.53 | −1.17 | −0.76 | −1.48 | −0.70 | −0.91 | −1.03 | −0.97 | | 0 | HGG 2 |
| 2253102 | −1.20 | −1.58 to −0.91 | −1.58 | −1.30 | −1.22 | −1.25 | −1.11 | −1.03 | −0.91 | −1.23 | | 0 | HGG 2 |
| 2268923 | −1.18 | −1.51 to −1.02 | −1.51 | −1.22 | −1.10 | −1.15 | −1.18 | −1.02 | −1.04 | −1.20 | | 0 | HGG 2 |
| 1728013 | −1.11 | −1.39 to −0.85 | −1.20 | −1.27 | −0.94 | −1.39 | −0.85 | −1.08 | −1.10 | −1.08 | | 0 | HGG 2 |
| 2269058 | −1.15 | −1.37 to −0.81 | −1.37 | −1.32 | −1.08 | −1.19 | −0.81 | −0.96 | −1.12 | −1.33 | | 0 | HGG 2 |

TABLE 12-continued

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM, 1 hr | mean DE t/Dex 100 μM, 3 hr | mean DE t/Dex 100 μM, 6 hr | Cluster | GEM |
|---|---|---|---|---|---|---|---|---|---|---|---|---|---|
| 2284694 | −1.07 | −1.42 to −0.77 | −1.42 | −1.26 | −0.96 | −1.11 | −0.92 | −0.77 | −0.86 | −1.24 | | 0 | HGG 2 |
| 1823946 | −1.20 | −1.36 to −0.99 | −1.33 | −1.36 | −1.15 | −1.31 | −1.11 | −0.99 | −1.00 | −1.32 | | 0 | HGG 2 |
| 2285181 | −1.27 | −1.50 to −1.04 | −1.50 | −1.34 | −1.30 | −1.33 | −1.21 | −1.08 | −1.04 | −1.40 | | 0 | HGG 2 |
| 2285721 | −1.12 | −1.35 to −0.86 | −1.35 | −1.23 | −1.05 | −1.17 | −1.03 | −0.98 | −0.86 | −1.26 | | 0 | HGG 2 |
| 2286360 | −1.29 | −1.55 to −1.11 | −1.55 | −1.31 | −1.12 | −1.29 | −1.32 | −1.13 | −1.11 | −1.24 | | 0 | HGG 2 |
| 626471 | 0.71 | 0.00 to 1.80 | 1.80 | 1.28 | 1.08 | 1.55 | 0.00 | 0.00 | 0.00 | 0.00 | | 1 | HGG 2 |
| 755223 | 0.91 | 0.60 to 1.40 | 1.40 | 0.79 | 0.76 | 1.09 | 0.82 | 0.79 | 0.60 | 1.00 | | 1 | HGG 2 |
| 1323616 | 0.89 | 0.00 to 1.36 | 1.16 | 0.64 | 0.60 | 1.24 | 0.00 | 1.36 | 0.98 | 1.16 | | 1 | HGG 2 |
| 757514 | 0.89 | 0.00 to 1.48 | 1.15 | 0.57 | 0.60 | 1.18 | 0.00 | 1.10 | 1.04 | 1.48 | | 1 | HGG 2 |
| 869702 | 0.55 | 0.00 to 1.32 | 1.32 | 1.07 | 0.91 | 1.06 | 0.00 | 0.00 | 0.00 | 0.00 | | 1 | HGG 2 |
| 1501809 | 0.33 | −0.17 to 2.49 | −0.09 | −0.17 | 0.09 | 0.35 | 0.00 | 0.00 | 2.49 | 0.00 | | 1 | HGG 2 |
| 2018315 | 0.63 | 0.00 to 1.62 | 1.62 | 1.08 | 1.09 | 1.26 | 0.00 | 0.00 | 0.00 | 0.00 | | 1 | HGG 2 |
| 1515346 | 0.52 | 0.00 to 1.36 | 1.36 | 0.86 | 0.87 | 1.05 | 0.00 | 0.00 | 0.00 | 0.00 | | 1 | HGG 2 |
| 2044184 | 0.14 | −0.15 to 1.34 | −0.11 | 0.05 | −0.05 | −0.08 | 1.34 | 0.11 | 0.02 | −0.15 | | 1 | HGG 2 |
| 1559844 | 0.96 | 0.00 to 1.34 | 1.34 | 0.97 | 0.75 | 1.21 | 0.00 | 1.28 | 0.83 | 1.27 | | 1 | HGG 2 |
| 2025128 | 0.90 | 0.00 to 1.40 | 1.19 | 0.65 | 0.66 | 0.95 | 0.00 | 1.21 | 1.10 | 1.40 | | 1 | HGG 2 |
| 2230608 | 1.04 | 0.75 to 1.39 | 1.39 | 0.77 | 0.75 | 1.11 | 1.13 | 0.91 | 0.93 | 1.31 | | 1 | HGG 2 |
| 1670407 | 0.56 | 0.00 to 1.56 | 1.56 | 0.93 | 0.81 | 1.21 | 0.00 | 0.00 | 0.00 | 0.00 | | 1 | HGG 2 |
| 1696552 | 0.41 | −0.18 to 3.25 | 0.18 | −0.16 | −0.18 | 0.21 | 0.00 | 3.25 | 0.00 | 0.00 | | 1 | HGG 2 |
| 2499976 | 0.76 | 0.31 to 1.52 | 1.52 | 0.79 | 0.85 | 1.02 | 0.40 | 0.53 | 0.31 | 0.67 | | 1 | HGG 2 |
| 2394990 | 0.89 | 0.00 to 1.51 | 1.36 | 0.87 | 0.76 | 1.19 | 0.00 | 1.51 | 0.00 | 1.40 | | 1 | HGG 2 |
| 2725369 | 0.85 | 0.33 to 1.53 | 1.53 | 1.11 | 1.11 | 1.06 | 0.39 | 0.50 | 0.33 | 0.76 | | 1 | HGG 2 |
| 1822143 | 0.28 | −0.23 to 2.58 | −0.02 | −0.23 | −0.13 | 2.58 | 0.00 | 0.00 | 0.00 | 0.00 | | 1 | HGG 2 |
| 620879 | 0.31 | −0.01 to 2.30 | 0.08 | 0.08 | −0.01 | 0.02 | 0.00 | 2.30 | 0.00 | 0.00 | | 1 | HGG 2 |
| 1911819 | 0.48 | −0.20 to 1.39 | 1.39 | 0.89 | 0.77 | 0.56 | −0.20 | −0.01 | 0.13 | 0.31 | | 1 | HGG 2 |
| 2021989 | 1.06 | 0.00 to 1.74 | 1.19 | 0.76 | 0.86 | 1.17 | 0.00 | 1.74 | 1.24 | 1.50 | | 2 | HGG 2 |
| 1961617 | 2.02 | 0.00 to 3.29 | 2.47 | 1.76 | 1.46 | 2.46 | 0.00 | 2.33 | 2.36 | 3.29 | | 2 | HGG 2 |
| 1326255 | 2.29 | 1.58 to 2.83 | 2.83 | 2.44 | 2.26 | 2.42 | 2.33 | 2.19 | 1.58 | 2.24 | | 2 | HGG 2 |
| 1407125 | 1.38 | 1.21 to 1.64 | 1.64 | 1.21 | 1.22 | 1.43 | 1.25 | 1.37 | 1.31 | 1.62 | | 2 | HGG 2 |
| 1988540 | 1.23 | 0.72 to 1.66 | 1.64 | 1.22 | 0.96 | 1.66 | 1.15 | 1.13 | 0.72 | 1.37 | | 2 | HGG 2 |
| 960604 | 1.25 | 1.03 to 1.48 | 1.48 | 1.19 | 1.03 | 1.32 | 1.13 | 1.27 | 1.25 | 1.32 | | 2 | HGG 2 |
| 2837006 | 1.20 | 0.00 to 1.87 | 1.50 | 1.08 | 0.99 | 1.50 | 0.00 | 1.33 | 1.33 | 1.87 | | 2 | HGG 2 |
| 2124056 | 2.03 | 1.73 to 2.38 | 2.38 | 1.98 | 1.91 | 2.26 | 1.73 | 1.78 | 1.83 | 2.33 | | 2 | HGG 2 |
| 3206352 | 1.37 | 0.00 to 1.94 | 1.94 | 1.34 | 1.30 | 1.70 | 0.00 | 1.59 | 1.50 | 1.64 | | 2 | HGG 2 |
| 1709709 | 1.19 | 0.00 to 1.68 | 1.44 | 0.91 | 1.11 | 1.52 | 0.00 | 1.48 | 1.38 | 1.68 | | 2 | HGG 2 |
| 2544622 | 2.43 | 0.00 to 3.15 | 3.15 | 2.56 | 2.12 | 3.01 | 0.00 | 3.00 | 2.55 | 3.01 | | 2 | HGG 2 |
| 1848722 | −1.21 | −1.43 to −0.84 | −1.18 | −1.16 | −0.84 | −1.16 | −1.43 | −1.16 | −1.36 | −1.35 | | 3 | HGG 2 |
| 1988593 | −1.07 | −1.42 to −0.77 | −1.10 | −1.01 | −0.77 | −1.15 | −1.42 | −1.09 | −1.02 | −0.99 | | 3 | HGG 2 |
| 1511262 | −1.28 | −1.49 to −1.04 | −1.17 | −1.22 | −1.04 | −1.19 | −1.35 | −1.41 | −1.34 | −1.49 | | 3 | HGG 2 |
| 2394616 | −0.95 | −1.32 to −0.64 | −0.64 | −0.97 | −0.91 | −0.77 | −1.32 | −1.02 | −0.97 | −0.96 | | 3 | HGG 2 |
| 1594179 | −0.93 | −1.36 to −0.61 | −0.68 | −1.04 | −0.61 | −1.05 | −1.36 | −1.01 | −0.85 | −0.88 | | 3 | HGG 2 |
| 2925373 | −1.10 | −1.39 to −0.95 | −1.06 | −1.13 | −0.95 | −1.04 | −1.18 | −0.96 | −1.09 | −1.39 | | 3 | HGG 2 |
| 1706751 | −1.10 | −1.54 to −0.85 | −1.12 | −1.54 | −1.10 | −0.95 | −0.95 | −0.85 | −1.31 | −0.97 | | 3 | HGG 2 |
| 1988774 | −1.07 | −1.83 to −0.60 | −0.60 | −1.83 | −1.27 | −0.78 | −1.23 | −0.79 | −1.09 | −1.00 | | 3 | HGG 2 |
| 3284411 | −1.16 | −1.48 to −0.92 | −1.00 | −1.25 | −0.94 | −1.05 | −1.38 | −1.27 | −1.48 | −0.92 | | 3 | HGG 2 |
| 3421730 | −1.04 | −1.36 to −0.57 | −0.57 | −1.36 | −1.19 | −0.79 | −1.29 | −0.82 | −1.12 | −1.18 | | 3 | HGG 2 |
| 2914439 | −1.11 | −1.37 to −0.83 | −0.95 | −1.05 | −0.83 | −1.05 | −1.24 | −1.37 | −1.15 | −1.28 | | 3 | HGG 2 |
| 1520151 | −0.83 | −1.34 to 0.00 | −0.84 | −0.97 | −1.06 | −0.78 | 0.00 | −0.73 | −0.89 | −1.34 | | 4 | HGG 2 |
| 1616048 | −0.99 | −1.48 to 0.00 | −1.14 | −1.48 | −1.12 | −1.07 | 0.00 | −0.63 | −1.03 | −1.42 | | 4 | HGG 2 |
| 1753283 | −0.85 | −1.56 to 0.00 | −1.56 | −1.40 | −1.25 | −1.38 | 0.00 | 0.00 | 0.00 | −1.23 | | 4 | HGG 2 |
| 2703282 | −0.86 | −1.40 to 0.00 | −1.40 | −1.24 | −0.98 | −1.23 | 0.00 | 0.00 | −0.63 | −1.40 | | 4 | HGG 2 |
| 2294968 | −0.94 | −1.37 to 0.00 | −0.90 | −1.08 | −0.83 | −1.28 | 0.00 | −1.08 | −0.95 | −1.37 | | 4 | HGG 2 |
| 660142 | 1.94 | 0.00 to 3.08 | 2.95 | 2.40 | 2.18 | 2.60 | 0.00 | 0.00 | 2.29 | 3.08 | | 5 | HGG 2 |
| 2234266 | 1.15 | 0.00 to 2.86 | 2.86 | 1.94 | 1.64 | 0.00 | 0.00 | 0.00 | 0.00 | 2.80 | | 5 | HGG 2 |
| 1303862 | 1.58 | 0.00 to 3.10 | 3.10 | 2.37 | 1.66 | 2.51 | 0.00 | 0.00 | 0.00 | 3.00 | | 5 | HGG 2 |
| 1316801 | 1.28 | 0.00 to 2.43 | 2.43 | 1.99 | 1.70 | 2.24 | 0.00 | 0.00 | 0.00 | 1.84 | | 5 | HGG 2 |
| 2705256 | −0.20 | −1.40 to 0.16 | 0.16 | −0.23 | −0.12 | 0.00 | 0.00 | 0.00 | −1.40 | 0.02 | | 6 | HGG 2 |
| 3100048 | −0.99 | −2.17 to 0.08 0.00 to 0.00 0.00 to 0.00 | 0.08 | −1.53 | −1.27 | −0.30 | −1.10 | −0.47 | −2.17 | −1.19 | | 6 | HGG 2 |
| 1306062 | 0.18 | 0.00 to 1.46 | 0.00 | 0.00 | 0.00 | 0.00 | 0.00 | 1.46 | 0.00 | 0.00 | | 0 | HGG 3 |
| 4291619 | 0.17 | 0.00 to 1.36 | 0.00 | 0.00 | 0.00 | 0.00 | 0.00 | 1.36 | 0.00 | 0.00 | | 0 | HGG 3 |
| 1560380 | 0.20 | 0.00 to 1.62 | 0.00 | 0.00 | 0.00 | 0.00 | 0.00 | 1.62 | 0.00 | 0.00 | | 0 | HGG 3 |
| 3957354 | 0.31 | 0.00 to 2.51 | 0.00 | 0.00 | 0.00 | 0.00 | 0.00 | 2.51 | 0.00 | 0.00 | | 0 | HGG 3 |
| 4307290 | 0.17 | 0.00 to 1.36 | 0.00 | 0.00 | 0.00 | 0.00 | 0.00 | 1.36 | 0.00 | 0.00 | | 0 | HGG 3 |
| 1786554 | 0.46 | 0.00 to 1.48 | 0.00 | 0.00 | 0.90 | 0.00 | 0.00 | 1.26 | 0.00 | 1.48 | | 0 | HGG 3 |
| 4221092 | 0.18 | 0.00 to 1.42 | 0.00 | 0.00 | 0.00 | 0.00 | 0.00 | 1.42 | 0.00 | 0.00 | | 0 | HGG 3 |
| 872017 | 0.18 | 0.00 to 1.41 | 0.00 | 0.00 | 0.00 | 0.00 | 0.00 | 1.41 | 0.00 | 0.00 | | 0 | HGG 3 |
| 621543 | 0.21 | 0.00 to 1.68 | 0.00 | 0.00 | 0.00 | 0.00 | 0.00 | 1.68 | 0.00 | 0.00 | | 0 | HGG 3 |
| 5323022 | 0.17 | 0.00 to 1.33 | 0.00 | 0.00 | 0.00 | 0.00 | 0.00 | 1.33 | 0.00 | 0.00 | | 0 | HGG 3 |
| 4249090 | 0.17 | 0.00 to 1.36 | 0.00 | 0.00 | 0.00 | 0.00 | 0.00 | 1.36 | 0.00 | 0.00 | | 0 | HGG 3 |
| 2908546 | 0.18 | 0.00 to 1.41 | 0.00 | 0.00 | 0.00 | 0.00 | 0.00 | 1.41 | 0.00 | 0.00 | | 0 | HGG 3 |
| 5291215 | 0.17 | 0.00 to 1.40 | 0.00 | 0.00 | 0.00 | 0.00 | 0.00 | 1.40 | 0.00 | 0.00 | | 0 | HGG 3 |

TABLE 12-continued

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM, 1 hr | mean DE t/Dex 100 μM, 3 hr | mean DE t/Dex 100 μM, 6 hr | Cluster | GEM |
|---|---|---|---|---|---|---|---|---|---|---|---|---|---|
| 5262558 | 0.20 | 0.00 to 1.64 | 0.00 | 0.00 | 0.00 | 0.00 | 0.00 | 1.64 | 0.00 | 0.00 | | 0 | HGG 3 |
| 5206821 | 0.17 | 0.00 to 1.33 | 0.00 | 0.00 | 0.00 | 0.00 | 0.00 | 1.33 | 0.00 | 0.00 | | 0 | HGG 3 |
| 3074113 | 0.46 | 0.00 to 1.92 | 0.00 | 0.00 | 0.00 | 0.00 | 0.00 | 1.79 | 0.00 | 1.92 | | 0 | HGG 3 |
| 5138591 | 0.19 | 0.00 to 1.53 | 0.00 | 0.00 | 0.00 | 0.00 | 0.00 | 1.53 | 0.00 | 0.00 | | 0 | HGG 3 |
| 4252768 | 0.17 | 0.00 to 1.36 | 0.00 | 0.00 | 0.00 | 0.00 | 0.00 | 1.36 | 0.00 | 0.00 | | 0 | HGG 3 |
| 5115293 | 0.18 | 0.00 to 1.45 | 0.00 | 0.00 | 0.00 | 0.00 | 0.00 | 1.45 | 0.00 | 0.00 | | 0 | HGG 3 |
| 4717363 | 0.18 | 0.00 to 1.47 | 0.00 | 0.00 | 0.00 | 0.00 | 0.00 | 1.47 | 0.00 | 0.00 | | 0 | HGG 3 |
| 5106915 | 0.19 | 0.00 to 1.48 | 0.00 | 0.00 | 0.00 | 0.00 | 0.00 | 1.48 | 0.00 | 0.00 | | 0 | HGG 3 |
| 4611240 | 0.17 | 0.00 to 1.33 | 0.00 | 0.00 | 0.00 | 0.00 | 0.00 | 1.33 | 0.00 | 0.00 | | 0 | HGG 3 |
| 4505265 | 0.18 | 0.00 to 1.42 | 0.00 | 0.00 | 0.00 | 0.00 | 0.00 | 1.42 | 0.00 | 0.00 | | 0 | HGG 3 |
| 5038604 | 0.19 | 0.00 to 1.53 | 0.00 | 0.00 | 0.00 | 0.00 | 0.00 | 1.53 | 0.00 | 0.00 | | 0 | HGG 3 |
| 4883207 | 0.17 | 0.00 to 1.38 | 0.00 | 0.00 | 0.00 | 0.00 | 0.00 | 1.38 | 0.00 | 0.00 | | 0 | HGG 3 |
| 3408939 | 0.17 | 0.00 to 1.35 | 0.00 | 0.00 | 0.00 | 0.00 | 0.00 | 1.35 | 0.00 | 0.00 | | 0 | HGG 3 |
| 4872725 | 0.18 | 0.00 to 1.46 | 0.00 | 0.00 | 0.00 | 0.00 | 0.00 | 1.46 | 0.00 | 0.00 | | 0 | HGG 3 |
| 3736815 | 0.26 | 0.00 to 2.06 | 0.00 | 0.00 | 0.00 | 0.00 | 0.00 | 2.06 | 0.00 | 0.00 | | 0 | HGG 3 |
| 1319021 | −1.14 | −1.57 to −0.94 | −1.57 | −1.26 | −1.02 | −0.94 | −1.14 | −1.01 | −1.16 | −1.06 | | 1 | HGG 3 |
| 608725 | −1.04 | −1.42 to −0.79 | −1.42 | −1.30 | −0.88 | −1.24 | −0.84 | −0.79 | −0.88 | −0.94 | | 1 | HGG 3 |
| 678955 | −1.02 | −1.48 to −0.78 | −1.02 | −1.48 | −1.09 | −1.02 | −1.01 | −0.92 | −0.78 | −0.85 | | 1 | HGG 3 |
| 1911443 | −1.11 | −1.62 to −0.45 | −0.82 | −1.38 | −1.62 | −0.82 | −1.35 | −0.45 | −1.00 | −1.41 | | 1 | HGG 3 |
| 2863211 | −1.17 | −1.50 to −1.03 | −1.50 | −1.28 | −1.14 | −1.07 | −1.15 | −1.03 | −1.17 | −1.05 | | 1 | HGG 3 |
| 3086833 | −1.06 | −1.38 to −0.75 | −1.38 | −1.33 | −1.11 | −1.29 | −0.77 | −0.75 | −0.91 | −0.94 | | 1 | HGG 3 |
| 3098189 | −1.11 | −1.46 to −0.67 | −1.46 | −1.33 | −1.22 | −1.26 | −0.67 | −0.96 | −0.81 | −1.13 | | 1 | HGG 3 |
| 3125211 | −1.16 | −1.65 to −0.79 | −1.65 | −1.19 | −1.15 | −1.39 | −0.83 | −0.86 | −0.79 | −1.38 | | 1 | HGG 3 |
| 3135460 | −1.11 | −1.78 to −0.66 | −0.93 | −1.11 | −1.78 | −1.05 | −1.14 | −0.66 | −0.78 | −1.44 | | 1 | HGG 3 |
| 3778404 | −1.31 | −1.67 to −0.87 | −1.45 | −1.40 | −1.46 | −1.57 | −1.16 | −0.87 | −0.91 | −1.67 | | 1 | HGG 3 |
| 3983862 | −0.98 | −1.38 to −0.78 | −1.38 | −1.20 | −0.84 | −0.92 | −0.82 | −0.78 | −0.93 | −0.99 | | 1 | HGG 3 |
| 4334474 | −1.07 | −1.40 to −0.92 | −1.40 | −1.32 | −0.98 | −1.06 | −0.92 | −0.94 | −0.98 | −0.92 | | 1 | HGG 3 |
| 4464538 | −1.05 | −1.45 to −0.67 | −1.45 | −1.22 | −0.99 | −1.30 | −0.67 | −0.83 | −0.82 | −1.12 | | 1 | HGG 3 |
| 4860060 | −1.29 | −1.50 to −1.20 | −1.50 | −1.42 | −1.20 | −1.29 | −1.21 | −1.22 | −1.23 | −1.30 | | 1 | HGG 3 |
| 5399371 | −1.27 | −1.57 to −0.95 | −1.42 | −1.43 | −1.31 | −1.57 | −1.46 | −1.13 | −1.08 | −0.95 | | 1 | HGG 3 |
| 5426158 | −1.03 | −1.44 to −0.62 | −1.06 | −1.44 | −1.10 | −0.71 | −0.99 | −0.62 | −1.28 | −1.01 | | 1 | HGG 3 |
| 5322365 | 1.21 | 0.89 to 1.64 | 1.64 | 1.19 | 0.89 | 1.24 | 1.04 | 1.24 | 1.06 | 1.34 | | 2 | HGG 3 |
| 2545486 | 2.03 | 0.00 to 3.28 | 0.00 | 2.65 | 2.15 | 2.77 | 0.00 | 3.28 | 2.53 | 2.87 | | 2 | HGG 3 |
| 4253809 | 1.72 | 1.44 to 1.97 | 1.97 | 1.44 | 1.59 | 1.79 | 1.69 | 1.85 | 1.56 | 1.89 | | 2 | HGG 3 |
| 4402555 | 1.88 | 0.00 to 2.68 | 0.00 | 1.93 | 2.12 | 2.68 | 1.90 | 1.94 | 1.95 | 2.53 | | 2 | HGG 3 |
| 3069190 | 3.29 | 0.00 to 4.14 | 0.00 | 3.58 | 3.53 | 3.89 | 3.58 | 3.82 | 3.73 | 4.14 | | 2 | HGG 3 |
| 3172265 | 3.74 | 3.15 to 4.12 | 3.98 | 3.69 | 3.15 | 3.72 | 3.66 | 4.12 | 3.63 | 3.99 | | 2 | HGG 3 |
| 4912315 | 1.38 | 0.00 to 2.62 | 0.00 | 2.01 | 1.33 | 2.59 | 0.00 | 2.49 | 0.00 | 2.62 | | 2 | HGG 3 |
| 3158828 | 1.61 | 0.95 to 2.12 | 1.91 | 1.85 | 1.73 | 2.12 | 0.95 | 1.39 | 1.16 | 1.75 | | 2 | HGG 3 |
| 2343348 | 1.50 | 1.18 to 2.02 | 2.02 | 1.67 | 1.23 | 1.60 | 1.18 | 1.45 | 1.38 | 1.47 | | 2 | HGG 3 |
| 5266015 | 2.28 | 2.05 to 2.62 | 2.62 | 2.14 | 2.12 | 2.57 | 2.05 | 2.08 | 2.08 | 2.56 | | 2 | HGG 3 |
| 2972013 | 1.19 | 0.90 to 1.69 | 1.69 | 1.31 | 0.94 | 1.47 | 0.90 | 1.00 | 0.96 | 1.26 | | 2 | HGG 3 |
| 5293028 | 1.16 | 0.70 to 1.55 | 1.35 | 1.11 | 0.70 | 1.15 | 1.08 | 1.31 | 1.03 | 1.55 | | 2 | HGG 3 |
| 1636594 | 0.25 | 0.00 to 1.38 | 0.00 | 1.38 | 0.00 | 0.00 | 0.00 | 0.62 | 0.00 | 0.00 | | 3 | HGG 3 |
| 5321996 | 0.47 | 0.00 to 1.64 | 0.00 | 1.64 | 0.63 | 0.40 | 0.00 | 0.53 | 0.00 | 0.59 | | 3 | HGG 3 |
| 3614283 | 0.46 | 0.00 to 1.39 | 0.00 | 0.43 | 0.27 | 1.39 | 0.22 | 0.44 | 0.57 | 0.37 | | 3 | HGG 3 |
| 3003980 | 0.22 | 0.00 to 1.79 | 0.00 | 0.00 | 0.00 | 1.79 | 0.00 | 0.00 | 0.00 | 0.00 | | 3 | HGG 3 |
| 5102731 | 0.52 | −0.22 to 1.36 | 0.00 | 0.87 | −0.22 | 1.09 | 0.00 | 1.08 | 0.00 | 1.36 | | 3 | HGG 3 |
| 4288091 | −0.05 | −1.36 to 0.95 | 0.00 | 0.00 | −1.36 | 0.00 | 0.00 | 0.95 | 0.00 | 0.00 | | 3 | HGG 3 |
| 4339883 | −0.21 | −1.67 to 0.00 | 0.00 | 0.00 | −1.67 | 0.00 | 0.00 | 0.00 | 0.00 | 0.00 | | 3 | HGG 3 |
| 630375 | −0.19 | −1.54 to 0.00 | 0.00 | 0.00 | −1.54 | 0.00 | 0.00 | 0.00 | 0.00 | 0.00 | | 3 | HGG 3 |
| 641510 | −0.26 | −2.05 to 0.00 | 0.00 | 0.00 | −2.05 | 0.00 | 0.00 | 0.00 | 0.00 | 0.00 | | 3 | HGG 3 |
| 748477 | 0.91 | 0.42 to 1.33 | 1.33 | 0.42 | 0.54 | 1.27 | 1.08 | 0.75 | 0.82 | 1.05 | | 3 | HGG 3 |
| 777716 | −0.20 | −1.57 to 0.00 | 0.00 | 0.00 | −1.57 | 0.00 | 0.00 | 0.00 | 0.00 | 0.00 | | 3 | HGG 3 |
| 2698777 | −1.48 | −1.74 to −1.17 | −1.55 | −1.66 | −1.58 | −1.17 | −1.36 | −1.28 | −1.50 | | | 4 | HGG 3 |
| 4289557 | −1.92 | −2.45 to −1.40 | −2.03 | −2.11 | −2.00 | −2.28 | −1.44 | −1.66 | −1.40 | −2.45 | | 4 | HGG 3 |
| 5573549 | −1.80 | −2.16 to −1.44 | −2.16 | −2.01 | −1.69 | −1.93 | −1.47 | −1.44 | −1.69 | −2.01 | | 4 | HGG 3 |
| 5091002 | −1.42 | −1.93 to −1.03 | −1.61 | −1.54 | −1.79 | −1.93 | −1.03 | −1.07 | −1.07 | −1.35 | | 4 | HGG 3 |
| 3097624 | −1.53 | −1.82 to −1.22 | −1.79 | −1.82 | −1.42 | −1.76 | −1.22 | −1.37 | −1.37 | −1.49 | | 4 | HGG 3 |
| 3084204 | −1.51 | −1.76 to −1.15 | −1.70 | −1.53 | −1.50 | −1.73 | −1.37 | −1.32 | −1.15 | −1.76 | | 4 | HGG 3 |
| 5166479 | −1.58 | −2.16 to −1.08 | −1.26 | −2.16 | −1.73 | −1.52 | −1.64 | −1.23 | −2.03 | −1.08 | | 4 | HGG 3 |
| 4715924 | −0.93 | −1.45 to −0.63 | −1.23 | −0.98 | −0.78 | −1.45 | −0.63 | −0.72 | −0.73 | −0.91 | | 5 | HGG 3 |
| 1732792 | −0.91 | −1.33 to 0.60 | −1.33 | −1.20 | −0.89 | −1.16 | −0.66 | −0.63 | −0.60 | −0.81 | | 5 | HGG 3 |
| 5281739 | −0.85 | −1.44 to −0.39 | −0.87 | −0.98 | −0.88 | −1.44 | −0.47 | −0.82 | −0.39 | −0.92 | | 5 | HGG 3 |
| 3120209 | −1.91 | −2.77 to −1.04 | −2.55 | −2.30 | −1.26 | −2.77 | −1.17 | −2.46 | −1.73 | −1.04 | | 6 | HGG 3 |
| 5427710 | −1.99 | −2.31 to −1.50 | −2.17 | −2.16 | −1.97 | −2.08 | −1.50 | −1.90 | −1.79 | −2.31 | | 6 | HGG 3 |
| | | 0.00 to 0.00 | | | | | | | | | | | |
| | | 0.00 to 0.00 | | | | | | | | | | | |
| 1259841 | 0.84 | 0.35 to 1.35 | 0.96 | 0.35 | 0.70 | 1.07 | 1.35 | 0.68 | 0.60 | 0.80 | 1.06 | 0 | HGG 4 |
| 1365045 | 1.30 | 0.00 to 1.89 | 1.89 | 1.31 | 1.19 | 1.56 | 0.00 | 1.13 | 1.38 | 1.44 | 1.82 | 0 | HGG 4 |
| 1370137 | 1.19 | 0.00 to 2.55 | 0.00 | 2.08 | 2.00 | 2.55 | 0.00 | 1.88 | 2.18 | 0.00 | 0.00 | 0 | HGG 4 |
| 439415 | 1.23 | 1.12 to 1.38 | 1.38 | 1.12 | 1.16 | 1.25 | 1.21 | 1.28 | 1.23 | 1.17 | 1.30 | 0 | HGG 4 |
| 1913334 | 1.31 | 0.74 to 1.74 | 1.74 | 1.04 | 1.08 | 1.34 | 1.68 | 0.74 | 1.13 | 1.32 | 1.74 | 0 | HGG 4 |

TABLE 12-continued

| Clone ID | Ave DE t/Dex | Range | mean DE t/Dex 1 μM, 1 hr | mean DE t/Dex 1 μM, 3 hr | mean DE t/Dex 1 μM, 6 hr | mean DE t/Dex 10 μM, 1 hr | mean DE t/Dex 10 μM, 3 hr | mean DE t/Dex 10 μM, 6 hr | mean DE t/Dex 100 μM, 1 hr | mean DE t/Dex 100 μM, 3 hr | mean DE t/Dex 100 μM, 6 hr | Cluster | GEM |
|---|---|---|---|---|---|---|---|---|---|---|---|---|---|
| 1946155 | 0.93 | 0.68 to 1.33 | 1.33 | 0.86 | 0.75 | 0.98 | 1.09 | 0.68 | 0.75 | 0.78 | 1.09 | 0 | HGG 4 |
| 409209 | 0.69 | 0.30 to 1.50 | 1.00 | 0.36 | 0.35 | 0.91 | 1.50 | 0.40 | 0.62 | 0.30 | 0.78 | 0 | HGG 4 |
| 3016137 | 1.46 | 1.04 to 1.93 | 1.66 | 1.15 | 1.04 | 1.38 | 1.93 | 1.90 | 1.65 | 1.11 | 1.29 | 0 | HGG 4 |
| 1965856 | 1.17 | 0.91 to 1.69 | 1.46 | 0.91 | 0.95 | 1.33 | 1.69 | 0.97 | 0.96 | 0.97 | 1.25 | 0 | HGG 4 |
| 2007730 | 1.06 | 0.82 to 1.34 | 1.34 | 0.82 | 0.86 | 1.00 | 1.27 | 0.85 | 1.05 | 1.17 | 1.21 | 0 | HGG 4 |
| 2408333 | 0.91 | 0.00 to 1.51 | 1.51 | 0.93 | 0.96 | 1.27 | 0.00 | 0.81 | 1.15 | 0.68 | 0.93 | 0 | HGG 4 |
| 2619275 | 0.99 | 0.00 to 1.43 | 1.43 | 0.91 | 0.92 | 1.16 | 0.00 | 0.95 | 1.03 | 1.24 | 1.31 | 0 | HGG 4 |
| 2106010 | 1.25 | 0.00 to 1.83 | 1.75 | 1.14 | 1.14 | 1.45 | 0.00 | 1.16 | 1.43 | 1.37 | 1.83 | 0 | HGG 4 |
| 2110482 | 1.48 | 0.98 to 1.94 | 1.85 | 0.98 | 1.37 | 1.51 | 1.70 | 1.15 | 1.25 | 1.57 | 1.94 | 0 | HGG 4 |
| 5101167 | 0.99 | 0.69 to 1.38 | 1.38 | 0.81 | 0.90 | 1.07 | 1.23 | 0.69 | 0.87 | 0.81 | 1.12 | 0 | HGG 4 |
| 5690026 | 1.02 | 0.00 to 1.79 | 1.79 | 1.11 | 1.35 | 1.49 | 0.00 | 1.02 | 1.12 | 1.31 | 0.00 | 0 | HGG 4 |
| 198719 | −1.19 | −1.53 to −0.94 | −1.48 | −1.19 | −1.13 | −1.39 | −1.53 | −0.94 | −1.00 | −1.02 | −1.00 | 1 | HGG 4 |
| 1416978 | −1.04 | −1.36 to −0.91 | −1.36 | −1.11 | −1.10 | −1.04 | −0.91 | −0.94 | −0.91 | −0.93 | −1.01 | 1 | HGG 4 |
| 1805836 | −1.02 | −1.43 to −0.79 | −1.43 | −1.17 | −0.94 | −1.16 | −0.79 | −0.83 | −1.02 | −0.93 | −0.88 | 1 | HGG 4 |
| 3042227 | −1.75 | −2.23 to −1.30 | −1.92 | −1.74 | −1.53 | −1.85 | −2.23 | −1.74 | −1.58 | −1.30 | −1.85 | 1 | HGG 4 |
| 1857850 | −1.95 | −2.18 to −1.62 | −2.18 | −2.07 | −1.85 | −2.02 | −2.08 | −1.62 | −1.96 | −1.71 | −2.10 | 1 | HGG 4 |
| 1953051 | −1.49 | −1.80 to −1.23 | −1.74 | −1.57 | −1.26 | −1.80 | −1.79 | −1.23 | −1.27 | −1.35 | −1.35 | 1 | HGG 4 |
| 495808 | −1.18 | −1.51 to −0.89 | −1.51 | −1.39 | −1.12 | −1.18 | −1.42 | −1.05 | −1.10 | −0.89 | −0.99 | 1 | HGG 4 |
| 496946 | −1.08 | −1.41 to −0.83 | −1.41 | −1.28 | −0.92 | −1.07 | −1.27 | −1.05 | −1.02 | −0.83 | −0.89 | 1 | HGG 4 |
| 2786442 | −1.57 | −2.20 to −1.16 | −2.20 | −1.68 | −1.18 | −1.91 | −2.04 | −1.25 | −1.52 | −1.23 | −1.16 | 1 | HGG 4 |
| 562585 | −1.21 | −1.50 to −1.04 | −1.50 | −1.37 | −1.23 | −1.20 | −1.18 | −1.07 | −1.07 | −1.04 | −1.21 | 1 | HGG 4 |
| 1383138 | −1.14 | −1.53 to −0.66 | −0.66 | −1.53 | −1.35 | −0.88 | −1.30 | −1.24 | −0.79 | −1.15 | −1.34 | 1 | HGG 4 |
| 3144511 | 0.26 | 0.00 to 2.30 | 0.00 | 0.00 | 0.00 | 0.00 | 0.00 | 2.30 | 0.00 | 0.00 | 0.00 | 2 | HGG 4 |
| 3149570 | 0.39 | 0.00 to 1.44 | 0.00 | 0.99 | 1.08 | 1.44 | 0.00 | 0.00 | 0.00 | 0.00 | 0.00 | 2 | HGG 4 |
| 3926757 | 0.48 | 0.00 to 1.36 | 0.12 | 1.36 | 1.04 | 0.47 | 0.00 | 0.46 | 0.34 | 0.34 | 0.17 | 2 | HGG 4 |
| 4003219 | 0.19 | 0.00 to 1.67 | 0.00 | 0.00 | 1.67 | 0.00 | 0.00 | 0.00 | 0.00 | 0.00 | 0.00 | 2 | HGG 4 |
| 2009252 | 0.20 | 0.00 to 1.38 | 0.00 | 1.38 | 0.40 | 0.00 | 0.00 | 0.00 | 0.00 | 0.00 | 0.00 | 2 | HGG 4 |
| 220378 | 0.39 | 0.00 to 1.34 | 0.00 | 1.01 | 0.00 | 1.34 | 0.00 | 1.14 | 0.00 | 0.00 | 0.00 | 2 | HGG 4 |
| 509839 | 0.64 | 0.00 to 1.44 | 0.00 | 1.26 | 0.90 | 1.44 | 0.00 | 0.94 | 1.23 | 0.00 | 0.00 | 2 | HGG 4 |
| 2405487 | 0.69 | 0.00 to 1.53 | 0.00 | 1.06 | 1.28 | 1.53 | 0.00 | 1.05 | 1.25 | 0.00 | 0.00 | 2 | HGG 4 |
| 2410066 | 0.45 | 0.00 to 1.65 | 0.00 | 1.14 | 1.24 | 1.65 | 0.00 | 0.00 | 0.00 | 0.00 | 0.00 | 2 | HGG 4 |
| 2571644 | 0.28 | 0.00 to 2.54 | 0.00 | 0.00 | 0.00 | 0.00 | 0.00 | 0.00 | 0.00 | 0.00 | 2.54 | 2 | HGG 4 |
| 4792726 | −0.70 | −1.34 to 0.00 | −1.34 | −1.10 | −0.59 | −0.91 | 0.00 | −0.78 | −0.96 | −0.65 | 0.00 | 3 | HGG 4 |
| 1876829 | −0.94 | −1.40 to −0.64 | −1.16 | −1.40 | −0.81 | −0.95 | −0.78 | −0.87 | −1.01 | −0.89 | −0.64 | 3 | HGG 4 |
| 1857664 | −0.71 | −1.39 to −0.23 | −1.00 | −0.73 | −0.23 | −1.02 | −1.39 | −0.48 | −0.71 | −0.35 | −0.46 | 3 | HGG 4 |
| 2420388 | −0.17 | −1.50 to 0.00 | 0.00 | 0.00 | 0.00 | 0.00 | 0.00 | 0.00 | 0.00 | 0.00 | −1.50 | 3 | HGG 4 |
| 1377668 | −0.81 | −1.34 to −0.43 | −1.34 | −0.94 | −0.71 | −0.99 | −0.43 | −0.59 | −0.91 | −0.68 | −0.74 | 3 | HGG 4 |
| 2581075 | 3.38 | 2.87 to 4.02 | 3.81 | 3.09 | 2.87 | 3.41 | 4.02 | 3.12 | 3.37 | 3.26 | 3.46 | 4 | HGG 4 |
| 3191030 | 1.97 | 1.28 to 2.65 | 2.65 | 1.67 | 1.28 | 2.03 | 2.38 | 1.74 | 2.01 | 1.65 | 2.35 | 4 | HGG 4 |
| 1964758 | 1.84 | 0.00 to 2.52 | 2.52 | 1.83 | 1.89 | 2.24 | 0.00 | 1.89 | 1.94 | 1.93 | 2.30 | 4 | HGG 4 |
| 434751 | 1.69 | 1.31 to 2.21 | 1.89 | 1.49 | 1.31 | 1.73 | 2.21 | 1.63 | 1.69 | 1.40 | 1.86 | 4 | HGG 4 |
| 2278772 | 1.94 | 1.54 to 2.44 | 2.18 | 1.65 | 1.54 | 2.22 | 2.44 | 1.83 | 1.94 | 1.99 | 1.70 | 4 | HGG 4 |
| 2055569 | −1.29 | −2.08 to −0.57 | −0.61 | −1.36 | −1.89 | −0.94 | −0.57 | −2.08 | −1.14 | −1.59 | −1.43 | 5 | HGG 4 |
| 1449819 | −1.47 | −2.15 to −0.37 | −0.68 | −1.95 | −2.15 | −0.37 | −1.18 | −2.14 | −0.73 | −2.14 | −1.93 | 5 | HGG 4 |

TABLE 13

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 2886955 | −1.69 | −1.94 to −1.20 | −1.76 | −1.66 | −1.71 | −1.20 | −1.91 | −1.94 | −1.64 | −1.69 | 0 | HGG 1 |
| 1807155 | −0.87 | −1.40 to −0.16 | −0.34 | −0.80 | −1.27 | −0.16 | −1.40 | −0.68 | −1.12 | −1.18 | 0 | HGG 1 |
| 4698018 | −1.21 | −1.43 to −0.98 | −1.14 | −1.14 | −1.13 | −0.98 | −1.43 | −1.16 | −1.27 | −1.40 | 0 | HGG 1 |
| 4408943 | −1.52 | −1.92 to −0.82 | −1.34 | −1.70 | −1.74 | −0.82 | −1.92 | −1.39 | −1.62 | −1.63 | 0 | HGG 1 |
| 1833362 | −1.08 | −1.41 to −0.42 | −0.85 | −1.19 | −1.33 | −0.42 | −1.41 | −1.01 | −1.21 | −1.22 | 0 | HGG 1 |
| 1840426 | −1.09 | −1.36 to −0.72 | −0.84 | −0.96 | −1.31 | −0.72 | −1.36 | −1.13 | −1.19 | −1.19 | 0 | HGG 1 |
| 41479 | −0.98 | −1.34 to −0.41 | −0.76 | −0.97 | −1.19 | −0.41 | −1.22 | −0.93 | −1.34 | −0.98 | 0 | HGG 1 |
| 2769888 | −1.03 | −1.49 to −0.50 | −0.75 | −1.20 | −1.49 | −0.74 | −1.35 | −0.50 | −0.98 | −1.23 | 0 | HGG 1 |
| 1868536 | −1.12 | −1.63 to 0.00 | −0.84 | −1.23 | −1.49 | 0.00 | −1.63 | −1.10 | −1.28 | −1.40 | 0 | HGG 1 |
| 1876456 | −1.47 | −1.60 to −1.27 | −1.60 | −1.37 | −1.48 | −1.55 | −1.50 | −1.52 | −1.45 | −1.27 | 0 | HGG 1 |
| 1890576 | −1.52 | −1.85 to −1.10 | −1.47 | −1.35 | −1.41 | −1.10 | −1.85 | −1.77 | −1.63 | −1.57 | 0 | HGG 1 |
| 1910401 | −1.27 | −1.62 to −0.72 | −1.00 | −1.32 | −1.35 | −0.72 | −1.62 | −1.35 | −1.30 | −1.47 | 0 | HGG 1 |
| 2506973 | −1.52 | −1.98 to −0.88 | −1.38 | −1.32 | −1.63 | −0.88 | −1.98 | −1.66 | −1.78 | −1.54 | 0 | HGG 1 |
| 2839946 | −1.04 | −1.35 to −0.78 | −0.78 | −1.07 | −1.08 | −0.85 | −1.15 | −1.02 | −1.05 | −1.35 | 0 | HGG 1 |
| 2132607 | −1.10 | −1.33 to −0.78 | −0.89 | −1.10 | −1.22 | −0.78 | −1.33 | −1.11 | −1.21 | −1.20 | 0 | HGG 1 |
| 2471835 | −1.03 | −1.37 to −0.61 | −0.95 | −0.61 | −0.88 | −1.13 | −1.21 | −1.37 | −0.96 | −1.12 | 0 | HGG 1 |
| 1441245 | −1.38 | −1.48 to −1.18 | −1.48 | −1.42 | −1.38 | −1.18 | −1.45 | −1.35 | −1.35 | −1.42 | 0 | HGG 1 |

TABLE 13-continued

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 3975209 | −1.45 | −1.68 to −1.14 | −1.68 | −1.14 | −1.53 | −1.41 | −1.55 | −1.65 | −1.26 | −1.42 | 0 | HGG 1 |
| 3679667 | −1.39 | −1.53 to −1.22 | −1.48 | −1.52 | −1.46 | −1.53 | −1.31 | −1.22 | −1.31 | −1.28 | 0 | HGG 1 |
| 3451645 | −0.93 | −1.38 to −0.27 | −0.56 | −0.90 | −1.38 | −0.27 | −1.09 | −0.72 | −1.27 | −1.25 | 0 | HGG 1 |
| 1501410 | −0.98 | −1.33 to −0.72 | −0.94 | −1.15 | −1.33 | −0.90 | −1.10 | −0.72 | −0.85 | −0.87 | 0 | HGG 1 |
| 3031022 | −1.83 | −2.19 to −1.46 | −1.48 | −1.71 | −2.00 | −1.46 | −2.19 | −1.87 | −1.87 | −2.09 | 0 | HGG 1 |
| 2042056 | −1.53 | −1.89 to −1.20 | −1.89 | −1.72 | −1.44 | −1.52 | −1.37 | −1.62 | −1.46 | −1.20 | 0 | HGG 1 |
| 3001212 | −1.28 | −1.68 to −0.91 | −1.11 | −1.01 | −1.25 | −0.91 | −1.50 | −1.41 | −1.68 | −1.38 | 0 | HGG 1 |
| 2047730 | −1.29 | −1.70 to −0.43 | −0.96 | −1.31 | −1.70 | −0.43 | −1.55 | −1.29 | −1.53 | −1.53 | 0 | HGG 1 |
| 2912637 | −2.17 | −2.37 to −1.94 | −2.30 | −1.94 | −1.98 | −1.98 | −2.35 | −2.37 | −2.28 | −2.13 | 0 | HGG 1 |
| 1596220 | −1.65 | −2.05 to −0.89 | −1.40 | −1.63 | −1.82 | −0.89 | −2.05 | −1.73 | −1.84 | −1.88 | 0 | HGG 1 |
| 2061528 | −1.34 | −1.58 to −1.07 | −1.54 | −1.45 | −1.58 | −1.22 | −1.26 | −1.40 | −1.22 | −1.07 | 0 | HGG 1 |
| 891072 | −1.38 | −1.59 to −0.95 | −1.30 | −1.50 | −1.59 | −0.95 | −1.50 | −1.31 | −1.50 | −1.40 | 0 | HGG 1 |
| 1619292 | −1.45 | −1.66 to −1.23 | −1.41 | −1.29 | −1.49 | −1.23 | −1.66 | −1.50 | −1.48 | −1.54 | 0 | HGG 1 |
| 560115 | −1.87 | −2.18 to −1.19 | −1.50 | −2.17 | −1.98 | −1.19 | −2.14 | −1.78 | −2.18 | −2.03 | 0 | HGG 1 |
| 5541828 | −1.95 | −2.29 to −1.58 | −2.00 | −2.11 | −2.29 | −1.58 | −2.04 | −1.87 | −1.84 | −1.88 | 0 | HGG 1 |
| 5291518 | −1.30 | −1.57 to −0.99 | −1.50 | −1.57 | −1.51 | −1.44 | −1.25 | −1.18 | −1.00 | −0.99 | 0 | HGG 1 |
| 1652328 | −0.88 | −1.40 to 0.00 | −0.39 | −0.90 | −1.23 | 0.00 | −1.40 | −0.70 | −1.37 | −1.08 | 0 | HGG 1 |
| 2078880 | −0.75 | −1.35 to 0.00 | −0.31 | −0.65 | −1.11 | 0.00 | −1.10 | −0.41 | −1.08 | −1.35 | 0 | HGG 1 |
| 5047895 | −1.35 | −1.64 to −1.06 | −1.07 | −1.36 | −1.64 | −1.06 | −1.63 | −1.23 | −1.37 | −1.42 | 0 | HGG 1 |
| 1740474 | −1.49 | −1.87 to −1.01 | −1.41 | −1.25 | −1.48 | −1.01 | −1.87 | −1.50 | −1.67 | −1.77 | 0 | HGG 1 |
| 2516950 | 1.79 | 1.55 to 2.00 | 1.73 | 1.55 | 1.71 | 1.59 | 2.00 | 1.91 | 1.96 | 1.88 | 1 | HGG 1 |
| 1944123 | 1.37 | 1.10 to 1.53 | 1.33 | 1.21 | 1.10 | 1.35 | 1.47 | 1.53 | 1.44 | 1.52 | 1 | HGG 1 |
| 1956982 | 1.72 | 1.56 to 1.88 | 1.88 | 1.68 | 1.80 | 1.80 | 1.72 | 1.60 | 1.56 | 1.73 | 1 | HGG 1 |
| 1241484 | 1.25 | 0.94 to 1.49 | 1.06 | 0.94 | 1.12 | 1.15 | 1.49 | 1.43 | 1.40 | 1.43 | 1 | HGG 1 |
| 2120743 | 1.35 | 1.10 to 1.66 | 1.29 | 1.10 | 1.32 | 1.27 | 1.47 | 1.40 | 1.66 | 1.31 | 1 | HGG 1 |
| 1268277 | 1.35 | 0.91 to 1.76 | 0.97 | 0.91 | 1.03 | 1.19 | 1.76 | 1.62 | 1.59 | 1.74 | 1 | HGG 1 |
| 2697275 | 1.44 | 0.00 to 1.78 | 1.54 | 0.00 | 1.38 | 1.54 | 1.76 | 1.77 | 1.72 | 1.78 | 1 | HGG 1 |
| 2313349 | 1.69 | 1.53 to 1.85 | 1.53 | 1.56 | 1.64 | 1.69 | 1.77 | 1.82 | 1.85 | 1.68 | 1 | HGG 1 |
| 2445967 | 1.34 | 1.18 to 1.47 | 1.46 | 1.18 | 1.33 | 1.21 | 1.40 | 1.41 | 1.47 | 1.28 | 1 | HGG 1 |
| 1320685 | 1.60 | 1.27 to 1.88 | 1.70 | 1.88 | 1.80 | 1.51 | 1.42 | 1.68 | 1.52 | 1.27 | 1 | HGG 1 |
| 1342744 | 1.70 | 1.49 to 1.95 | 1.65 | 1.49 | 1.56 | 1.95 | 1.75 | 1.81 | 1.78 | 1.61 | 1 | HGG 1 |
| 2459765 | 1.51 | 1.08 to 1.86 | 1.41 | 1.08 | 1.22 | 1.86 | 1.65 | 1.68 | 1.58 | 1.61 | 1 | HGG 1 |
| 3108506 | 1.35 | 0.81 to 1.73 | 0.99 | 0.81 | 0.96 | 1.25 | 1.68 | 1.68 | 1.73 | 1.72 | 1 | HGG 1 |
| 3595618 | 1.43 | 1.13 to 1.59 | 1.38 | 1.13 | 1.33 | 1.56 | 1.51 | 1.59 | 1.54 | 1.42 | 1 | HGG 1 |
| 3687719 | 1.58 | 1.29 to 1.75 | 1.66 | 1.29 | 1.45 | 1.68 | 1.59 | 1.68 | 1.75 | 1.51 | 1 | HGG 1 |
| 3821432 | 1.43 | 1.17 to 1.87 | 1.43 | 1.17 | 1.26 | 1.87 | 1.46 | 1.53 | 1.46 | 1.22 | 1 | HGG 1 |
| 4021009 | 1.31 | 1.00 to 1.66 | 1.10 | 1.00 | 1.03 | 1.20 | 1.66 | 1.49 | 1.53 | 1.50 | 1 | HGG 1 |
| 4289063 | 1.26 | 1.00 to 1.51 | 1.09 | 1.00 | 1.12 | 1.09 | 1.51 | 1.34 | 1.45 | 1.45 | 1 | HGG 1 |
| 4978708 | 1.44 | 1.05 to 1.70 | 1.27 | 1.05 | 1.20 | 1.49 | 1.58 | 1.62 | 1.70 | 1.58 | 1 | HGG 1 |
| 2833342 | 1.50 | 1.22 to 1.68 | 1.45 | 1.22 | 1.32 | 1.62 | 1.59 | 1.68 | 1.65 | 1.45 | 1 | HGG 1 |
| 531505 | 1.38 | 1.08 to 1.64 | 1.08 | 1.23 | 1.14 | 1.35 | 1.48 | 1.53 | 1.64 | 1.57 | 1 | HGG 1 |
| 5397446 | 1.27 | 1.02 to 1.45 | 1.25 | 1.02 | 1.29 | 1.20 | 1.45 | 1.17 | 1.39 | 1.41 | 1 | HGG 1 |
| 1609387 | 1.49 | 1.19 to 1.77 | 1.34 | 1.19 | 1.31 | 1.37 | 1.77 | 1.69 | 1.59 | 1.64 | 1 | HGG 1 |
| 1684617 | 1.75 | 1.34 to 2.20 | 1.34 | 1.64 | 1.63 | 1.34 | 2.20 | 2.05 | 1.95 | 1.80 | 1 | HGG 1 |
| 2511277 | 1.77 | 0.00 to 2.33 | 1.62 | 0.00 | 1.58 | 2.15 | 2.20 | 2.33 | 2.24 | 2.03 | 1 | HGG 1 |
| 2005266 | 0.28 | 0.00 to 1.38 | 1.38 | 0.00 | 0.57 | 0.00 | 0.23 | 0.00 | 0.08 | 0.00 | 2 | HGG 1 |
| 275757 | 0.35 | 0.00 to 1.48 | 1.48 | 0.00 | 0.60 | 0.00 | 0.11 | 0.32 | 0.27 | 0.02 | 2 | HGG 1 |
| 3474091 | 0.23 | 0.00 to 1.36 | 1.36 | 0.00 | 0.48 | 0.00 | 0.00 | 0.00 | 0.00 | 0.00 | 2 | HGG 1 |
| 3479268 | 0.43 | 0.00 to 1.33 | 1.33 | 0.00 | 0.59 | 0.00 | 0.50 | 0.46 | 0.30 | 0.24 | 2 | HGG 1 |
| 126877 | 0.50 | 0.00 to 1.55 | 1.55 | 0.00 | 0.79 | 0.00 | 0.42 | 0.54 | 0.44 | 0.23 | 2 | HGG 1 |
| 128891 | 0.48 | 0.00 to 1.39 | 1.39 | 0.00 | 0.86 | 0.00 | 0.40 | 0.58 | 0.51 | 0.09 | 2 | HGG 1 |
| 1306222 | 0.16 | −0.15 to 1.39 | 0.17 | 0.00 | −0.08 | 1.39 | −0.15 | 0.03 | −0.01 | −0.08 | 2 | HGG 1 |
| 13504 | 0.40 | 0.00 to 1.36 | 1.36 | 0.00 | 0.61 | 0.00 | 0.39 | 0.48 | 0.34 | 0.05 | 2 | HGG 1 |
| 1415119 | 0.37 | 0.00 to 1.33 | 1.33 | 0.00 | 0.62 | 0.00 | 0.32 | 0.39 | 0.15 | 0.16 | 2 | HGG 1 |
| 262712 | 0.43 | 0.00 to 1.42 | 1.42 | 0.00 | 0.61 | 0.00 | 0.36 | 0.49 | 0.38 | 0.19 | 2 | HGG 1 |
| 5372104 | 0.34 | 0.00 to 1.33 | 1.33 | 0.00 | 0.67 | 0.00 | 0.00 | 0.40 | 0.31 | 0.00 | 2 | HGG 1 |
| 566093 | 0.27 | 0.00 to 1.34 | 1.34 | 0.00 | 0.52 | 0.00 | 0.19 | 0.00 | 0.11 | 0.00 | 2 | HGG 1 |
| 819036 | 0.51 | 0.00 to 1.34 | 1.34 | 0.00 | 0.69 | 0.00 | 0.47 | 0.51 | 0.51 | 0.53 | 2 | HGG 1 |
| 3607580 | 0.51 | 0.00 to 1.35 | 1.35 | 0.00 | 0.68 | 0.00 | 0.46 | 0.73 | 0.52 | 0.32 | 2 | HGG 1 |
| 3659618 | 0.18 | 0.00 to 1.46 | 1.46 | 0.00 | 0.00 | 0.00 | 0.00 | 0.00 | 0.00 | 0.00 | 2 | HGG 1 |
| 1571861 | 0.23 | −0.17 to 1.43 | 1.43 | 0.00 | 0.31 | 0.00 | 0.15 | 0.12 | 0.03 | −0.17 | 2 | HGG 1 |
| 1578941 | 0.43 | 0.00 to 1.33 | 1.33 | 0.00 | 0.63 | 0.00 | 0.40 | 0.52 | 0.35 | 0.23 | 2 | HGG 1 |
| 89691 | 0.49 | 0.00 to 1.36 | 1.36 | 0.00 | 0.77 | 0.00 | 0.46 | 0.61 | 0.49 | 0.21 | 2 | HGG 1 |
| 2008331 | 0.50 | 0.00 to 1.45 | 1.45 | 0.00 | 0.79 | 0.00 | 0.45 | 0.70 | 0.48 | 0.12 | 2 | HGG 1 |
| 2382190 | −0.40 | −1.42 to 0.07 | 0.07 | 0.00 | −0.74 | 0.00 | −1.42 | 0.00 | −1.14 | 0.00 | 2 | HGG 1 |
| 2132784 | 0.53 | 0.00 to 1.40 | 1.40 | 0.00 | 0.76 | 0.00 | 0.53 | 0.62 | 0.50 | 0.39 | 2 | HGG 1 |
| 3187861 | 0.36 | 0.00 to 1.39 | 1.39 | 0.00 | 0.52 | 0.00 | 0.37 | 0.00 | 0.34 | 0.26 | 2 | HGG 1 |
| 451090 | 0.49 | 0.00 to 1.43 | 1.43 | 0.00 | 0.66 | 0.00 | 0.52 | 0.67 | 0.46 | 0.17 | 2 | HGG 1 |
| 339737 | 0.51 | 0.00 to 1.49 | 1.49 | 0.00 | 0.66 | 0.00 | 0.58 | 0.55 | 0.49 | 0.27 | 2 | HGG 1 |
| 1820105 | 0.28 | 0.00 to 1.32 | 1.32 | 0.00 | 0.57 | 0.00 | 0.00 | 0.23 | 0.07 | 0.04 | 2 | HGG 1 |
| 1001486 | 0.87 | 0.43 to 1.36 | 0.81 | 0.43 | 0.68 | 1.20 | 0.73 | 1.36 | 0.91 | 0.85 | 3 | HGG 1 |
| 4403805 | 1.19 | 0.68 to 1.61 | 0.89 | 0.68 | 0.93 | 1.01 | 1.61 | 1.47 | 1.46 | 1.51 | 3 | HGG 1 |
| 1266985 | 0.74 | 0.38 to 1.41 | 0.87 | 0.38 | 0.45 | 1.41 | 0.54 | 1.03 | 0.66 | 0.58 | 3 | HGG 1 |

TABLE 13-continued

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 143765 | 1.15 | 0.91 to 1.42 | 0.94 | 0.96 | 1.00 | 0.91 | 1.42 | 1.26 | 1.29 | 1.40 | 3 | HGG 1 |
| 2933175 | 1.05 | 0.69 to 1.34 | 0.92 | 0.69 | 0.72 | 1.34 | 1.17 | 1.22 | 1.19 | 1.18 | 3 | HGG 1 |
| 1637145 | 0.94 | 0.71 to 1.37 | 0.87 | 0.71 | 0.88 | 1.37 | 0.72 | 1.24 | 0.84 | 0.92 | 3 | HGG 1 |
| 2252906 | 0.94 | 0.57 to 1.33 | 0.59 | 0.57 | 0.69 | 0.85 | 1.25 | 1.33 | 1.15 | 1.13 | 3 | HGG 1 |
| 172023 | 0.87 | 0.36 to 1.47 | 1.25 | 1.22 | 0.74 | 1.47 | 0.36 | 0.88 | 0.48 | 0.58 | 3 | HGG 1 |
| 1521272 | 1.20 | 1.02 to 1.36 | 1.16 | 1.21 | 1.10 | 1.02 | 1.36 | 1.35 | 1.36 | 1.07 | 3 | HGG 1 |
| 3606947 | 1.16 | 0.77 to 1.68 | 1.08 | 0.77 | 0.91 | 1.68 | 1.31 | 1.27 | 1.18 | 1.07 | 3 | HGG 1 |
| 5098879 | 1.15 | 0.63 to 1.53 | 1.04 | 0.63 | 0.78 | 1.20 | 1.53 | 1.38 | 1.37 | 1.26 | 3 | HGG 1 |
| 2148703 | 1.09 | 0.77 to 1.34 | 0.99 | 0.77 | 0.99 | 0.99 | 1.34 | 1.07 | 1.28 | 1.30 | 3 | HGG 1 |
| 4018288 | 1.14 | 0.89 to 1.59 | 0.97 | 0.89 | 0.94 | 1.11 | 1.59 | 1.32 | 1.15 | 1.20 | 3 | HGG 1 |
| 2482388 | 1.14 | 0.81 to 1.33 | 1.00 | 0.81 | 0.97 | 1.26 | 1.30 | 1.27 | 1.33 | 1.15 | 3 | HGG 1 |
| 4087621 | 1.09 | 0.77 to 1.46 | 1.46 | 1.34 | 1.08 | 1.27 | 0.77 | 1.06 | 0.77 | 0.96 | 3 | HGG 1 |
| 5398701 | 1.10 | 0.78 to 1.43 | 1.43 | 1.26 | 1.03 | 1.27 | 0.87 | 1.07 | 0.78 | 1.07 | 3 | HGG 1 |
| 5543385 | 1.15 | 0.97 to 1.46 | 1.10 | 0.97 | 1.06 | 1.46 | 0.98 | 1.39 | 1.19 | 1.05 | 3 | HGG 1 |
| 622565 | 1.17 | 0.96 to 1.44 | 0.96 | 0.97 | 1.04 | 0.97 | 1.44 | 1.28 | 1.33 | 1.34 | 3 | HGG 1 |
| 4195203 | 0.81 | 0.46 to 1.33 | 0.81 | 0.46 | 0.77 | 1.33 | 0.58 | 1.07 | 0.78 | 0.67 | 3 | HGG 1 |
| 1610828 | 1.24 | 1.03 to 1.35 | 1.32 | 1.25 | 1.03 | 1.23 | 1.24 | 1.35 | 1.33 | 1.20 | 3 | HGG 1 |
| 4286760 | 1.04 | 0.68 to 1.49 | 1.28 | 0.87 | 0.92 | 1.49 | 0.81 | 1.16 | 0.68 | 1.09 | 3 | HGG 1 |
| 1981569 | 0.58 | 0.00 to 1.42 | 1.42 | 0.00 | 0.69 | 0.00 | 0.73 | 0.73 | 0.57 | 0.47 | 4 | HGG 1 |
| 428897 | 0.71 | 0.00 to 1.68 | 1.68 | 0.00 | 1.06 | 0.00 | 0.68 | 0.76 | 0.80 | 0.66 | 4 | HGG 1 |
| 1824860 | 0.70 | 0.00 to 1.46 | 1.46 | 0.00 | 1.08 | 0.00 | 0.89 | 0.75 | 0.80 | 0.64 | 4 | HGG 1 |
| 4695453 | 0.77 | 0.00 to 1.42 | 1.42 | 0.00 | 0.98 | 0.00 | 0.93 | 1.07 | 0.95 | 0.82 | 4 | HGG 1 |
| 5285915 | 0.66 | 0.00 to 1.49 | 1.49 | 0.00 | 0.85 | 0.00 | 0.69 | 0.98 | 0.70 | 0.55 | 4 | HGG 1 |
| 1214989 | 0.54 | 0.00 to 1.39 | 1.39 | 0.00 | 0.69 | 0.00 | 0.66 | 0.57 | 0.56 | 0.46 | 4 | HGG 1 |
| 1496066 | 0.68 | 0.00 to 1.33 | 1.33 | 0.00 | 0.90 | 0.00 | 0.92 | 0.80 | 0.74 | 0.76 | 4 | HGG 1 |
| 1635877 | 0.78 | 0.00 to 1.54 | 1.54 | 0.00 | 1.01 | 0.00 | 0.89 | 1.15 | 0.91 | 0.72 | 4 | HGG 1 |
| 1503162 | 0.61 | 0.00 to 1.37 | 1.37 | 0.00 | 0.95 | 0.00 | 0.75 | 0.64 | 0.63 | 0.51 | 4 | HGG 1 |
| 1852354 | 0.85 | 0.00 to 1.44 | 1.44 | 0.00 | 1.15 | 0.00 | 1.18 | 1.06 | 0.97 | 0.99 | 4 | HGG 1 |
| 2046717 | 0.83 | 0.00 to 1.46 | 1.46 | 0.00 | 1.25 | 0.00 | 1.21 | 0.82 | 1.03 | 0.88 | 4 | HGG 1 |
| 3391835 | 0.90 | 0.00 to 1.82 | 1.82 | 0.00 | 1.37 | 0.00 | 0.98 | 0.86 | 1.11 | 1.08 | 4 | HGG 1 |
| 3434166 | 0.65 | 0.00 to 1.48 | 1.48 | 0.00 | 0.81 | 0.00 | 0.69 | 1.00 | 0.70 | 0.53 | 4 | HGG 1 |
| 3571607 | 0.85 | 0.00 to 1.34 | 1.34 | 0.00 | 1.16 | 0.00 | 1.14 | 1.02 | 1.12 | 0.99 | 4 | HGG 1 |
| 2956444 | 2.48 | 2.06 to 2.84 | 2.27 | 2.27 | 2.37 | 2.06 | 2.84 | 2.75 | 2.57 | 2.70 | 5 | HGG 1 |
| 2778441 | 1.97 | 1.60 to 2.20 | 1.72 | 1.60 | 1.80 | 2.05 | 2.19 | 2.20 | 2.02 | 2.18 | 5 | HGG 1 |
| 548114 | 1.97 | 1.79 to 2.11 | 2.11 | 1.93 | 1.89 | 1.79 | 2.05 | 2.02 | 1.92 | 2.08 | 5 | HGG 1 |
| 5509134 | 2.26 | 1.95 to 2.50 | 2.19 | 2.23 | 1.95 | 1.95 | 2.41 | 2.35 | 2.50 | 2.49 | 5 | HGG 1 |
| 4287327 | 2.30 | 2.13 to 2.65 | 2.24 | 2.32 | 2.30 | 2.28 | 2.26 | 2.13 | 2.65 | 2.20 | 5 | HGG 1 |
| 3606046 | 2.27 | 1.87 to 2.68 | 2.18 | 1.87 | 2.01 | 2.25 | 2.68 | 2.46 | 2.32 | 2.36 | 5 | HGG 1 |
| 2823767 | 2.06 | 1.44 to 2.30 | 2.02 | 2.25 | 2.22 | 1.44 | 2.30 | 2.28 | 2.15 | 1.81 | 5 | HGG 1 |
| 3068809 | 2.27 | 1.94 to 2.49 | 2.09 | 1.94 | 2.17 | 2.34 | 2.39 | 2.49 | 2.40 | 2.34 | 5 | HGG 1 |
| 617587 | 2.35 | 1.76 to 2.59 | 2.52 | 2.33 | 2.59 | 2.24 | 2.58 | 2.41 | 2.35 | 1.76 | 5 | HGG 1 |
| 459372 | 2.00 | 1.82 to 2.12 | 2.07 | 1.94 | 1.87 | 1.82 | 2.12 | 2.10 | 1.99 | 2.10 | 5 | HGG 1 |
| 1459743 | 1.92 | 1.65 to 2.21 | 1.78 | 1.65 | 1.70 | 1.78 | 2.21 | 2.18 | 1.95 | 2.06 | 5 | HGG 1 |
| 1457424 | 2.33 | 1.85 to 2.62 | 2.28 | 2.26 | 2.19 | 1.85 | 2.62 | 2.39 | 2.53 | 2.55 | 5 | HGG 1 |
| 2756333 | 1.92 | 1.40 to 2.31 | 1.65 | 1.40 | 1.59 | 2.01 | 2.31 | 2.13 | 2.13 | 2.17 | 5 | HGG 1 |
| 2695371 | 0.95 | 0.00 to 1.56 | 1.14 | 0.00 | 0.92 | 0.00 | 1.56 | 1.36 | 1.27 | 1.33 | 6 | HGG 1 |
| 1210839 | 0.99 | 0.00 to 1.50 | 1.44 | 0.00 | 1.18 | 0.00 | 1.50 | 1.33 | 1.31 | 1.12 | 6 | HGG 1 |
| 4228236 | 0.87 | 0.00 to 1.41 | 1.17 | 0.00 | 1.20 | 0.00 | 1.41 | 1.34 | 1.17 | 0.63 | 6 | HGG 1 |
| 136073 | 0.99 | 0.00 to 1.50 | 1.47 | 0.00 | 1.36 | 0.00 | 1.42 | 1.50 | 1.14 | 1.04 | 6 | HGG 1 |
| 1756875 | 1.24 | 0.00 to 1.80 | 1.74 | 0.00 | 1.37 | 0.00 | 1.80 | 1.73 | 1.62 | 1.65 | 6 | HGG 1 |
| 1857044 | 0.89 | 0.00 to 1.33 | 1.19 | 0.00 | 1.02 | 0.00 | 1.33 | 1.18 | 1.15 | 1.21 | 6 | HGG 1 |
| 1979363 | 0.85 | 0.00 to 1.34 | 0.89 | 0.00 | 0.94 | 0.00 | 1.34 | 1.22 | 1.23 | 1.16 | 6 | HGG 1 |
| 2061171 | 1.14 | 0.00 to 1.79 | 1.40 | 0.00 | 1.32 | 0.00 | 1.79 | 1.60 | 1.52 | 1.53 | 6 | HGG 1 |
| 671717 | 1.11 | 0.00 to 1.77 | 1.29 | 0.00 | 1.24 | 0.00 | 1.77 | 1.46 | 1.61 | 1.52 | 6 | HGG 1 |
| 305751 | 0.95 | 0.00 to 1.53 | 1.24 | 0.00 | 1.04 | 0.00 | 1.31 | 1.30 | 1.22 | 1.53 | 6 | HGG 1 |
| 2173002 | 0.98 | 0.00 to 1.45 | 1.21 | 0.00 | 1.21 | 0.00 | 1.45 | 1.34 | 1.31 | 1.33 | 6 | HGG 1 |
| 2631261 | 0.97 | 0.00 to 1.40 | 1.00 | 0.62 | 0.76 | 0.00 | 1.35 | 1.40 | 1.32 | 1.33 | 6 | HGG 1 |
| 2823478 | 1.11 | 0.00 to 1.50 | 0.97 | 1.16 | 0.90 | 0.00 | 1.44 | 1.43 | 1.45 | 1.50 | 7 | HGG 1 |
| 3075994 | 1.14 | 0.72 to 1.38 | 1.06 | 0.98 | 0.99 | 0.72 | 1.38 | 1.32 | 1.37 | 1.33 | 7 | HGG 1 |
| 5521873 | 0.77 | 0.00 to 1.33 | 1.33 | 1.08 | 0.88 | 0.00 | 0.89 | 0.56 | 0.65 | 0.79 | 7 | HGG 1 |
| 2497692 | 0.93 | 0.00 to 1.37 | 0.88 | 0.85 | 0.94 | 0.00 | 1.37 | 1.18 | 1.07 | 1.13 | 7 | HGG 1 |
| 139949 | 0.97 | 0.00 to 1.69 | 1.69 | 1.21 | 1.19 | 0.00 | 0.75 | 1.25 | 1.01 | 0.67 | 7 | HGG 1 |
| 592085 | 0.95 | 0.46 to 1.33 | 0.79 | 0.61 | 0.77 | 0.46 | 1.33 | 1.29 | 1.13 | 1.17 | 7 | HGG 1 |
| 2403438 | 0.95 | 0.46 to 1.78 | 0.67 | 0.75 | 1.78 | 0.46 | 1.13 | 1.19 | 1.07 | 0.52 | 7 | HGG 1 |
| 2110430 | 1.25 | 0.00 to 1.84 | 1.84 | 1.81 | 1.84 | 0.00 | 1.04 | 1.21 | 1.37 | 0.88 | 7 | HGG 1 |
| 830408 | 1.04 | 0.00 to 1.39 | 1.34 | 1.01 | 1.13 | 0.00 | 1.39 | 1.19 | 1.16 | 1.06 | 7 | HGG 1 |
| 279898 | 1.30 | 0.19 to 2.06 | 0.41 | 1.85 | 1.84 | 0.19 | 2.06 | 0.88 | 1.32 | 1.90 | 7 | HGG 1 |
| 4549259 | 3.14 | 2.78 to 3.43 | 3.43 | 3.02 | 3.12 | 3.39 | 3.23 | 3.10 | 3.06 | 2.78 | 8 | HGG 1 |
| 1630990 | 3.25 | 2.92 to 3.50 | 3.14 | 3.19 | 3.17 | 2.92 | 3.50 | 3.21 | 3.41 | 3.47 | 8 | HGG 1 |
| 2755836 | 3.57 | 3.18 to 3.89 | 3.49 | 3.50 | 3.36 | 3.18 | 3.89 | 3.53 | 3.79 | 3.84 | 8 | HGG 1 |
| 5501676 | 2.66 | 0.00 to 3.40 | 3.31 | 3.40 | 2.99 | 0.00 | 3.38 | 2.62 | 2.80 | 2.78 | 8 | HGG 1 |
| 3792988 | 2.70 | 2.24 to 3.05 | 2.58 | 2.24 | 2.41 | 2.71 | 3.05 | 2.90 | 2.78 | 2.89 | 8 | HGG 1 |
| 2520894 | 2.77 | 2.55 to 3.06 | 2.65 | 2.55 | 2.66 | 2.70 | 3.06 | 2.89 | 2.87 | 2.83 | 8 | HGG 1 |

TABLE 13-continued

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 2818476 | 3.27 | 3.15 to 3.43 | 3.43 | 3.41 | 3.23 | 3.15 | 3.24 | 3.19 | 3.29 | 3.25 | 8 | HGG 1 |
| 4092112 | 1.61 | 0.00 to 2.07 | 1.93 | 1.84 | 1.57 | 0.00 | 2.07 | 1.97 | 1.82 | 1.71 | 9 | HGG 1 |
| 1560906 | 1.53 | 0.00 to 2.38 | 1.99 | 0.00 | 1.99 | 0.00 | 2.38 | 1.95 | 2.04 | 1.88 | 9 | HGG 1 |
| 4554722 | 1.42 | 0.00 to 1.91 | 1.53 | 1.32 | 1.08 | 0.00 | 1.85 | 1.91 | 1.79 | 1.84 | 9 | HGG 1 |
| 3497231 | 1.41 | 0.00 to 1.89 | 1.41 | 1.42 | 1.56 | 0.00 | 1.89 | 1.72 | 1.63 | 1.68 | 9 | HGG 1 |
| 686993 | 0.51 | 0.00 to 1.81 | 0.00 | 0.00 | 0.00 | 1.81 | 0.00 | 0.00 | 1.72 | | 0 | HGG 2 |
| 2173973 | 0.81 | 0.00 to 1.85 | 0.00 | 0.00 | 0.00 | 1.85 | 1.30 | 1.16 | 1.36 | | 0 | HGG 2 |
| 2189061 | 0.23 | 0.00 to 1.58 | 0.00 | 0.00 | 0.00 | 1.58 | 0.00 | 0.00 | 0.00 | | 0 | HGG 2 |
| 1364694 | 0.52 | 0.00 to 1.61 | 0.00 | 0.00 | 0.00 | 0.21 | 1.26 | 1.61 | 0.60 | | 0 | HGG 2 |
| 2189237 | 0.37 | 0.00 to 2.27 | 0.00 | 0.00 | 2.27 | 0.20 | 0.11 | 0.01 | 0.02 | | 0 | HGG 2 |
| 1469028 | 1.16 | 0.89 to 1.58 | 0.94 | 0.93 | 0.89 | 1.58 | 1.30 | 1.34 | 1.16 | | 0 | HGG 2 |
| 1515346 | 0.69 | 0.00 to 1.43 | 0.00 | 0.00 | 0.00 | 1.43 | 1.16 | 1.32 | 0.95 | | 0 | HGG 2 |
| 2222155 | 0.50 | 0.00 to 1.99 | 0.00 | 0.00 | 0.00 | 1.50 | 0.00 | 0.00 | 1.99 | | 0 | HGG 2 |
| 1569904 | 0.75 | 0.00 to 1.41 | 0.00 | 0.00 | 0.00 | 1.10 | 1.40 | 1.41 | 1.37 | | 0 | HGG 2 |
| 1670407 | 0.59 | 0.00 to 1.47 | 0.00 | 0.00 | 0.00 | 1.47 | 1.19 | 0.00 | 1.44 | | 0 | HGG 2 |
| 2246915 | 0.53 | 0.00 to 2.14 | 0.00 | 0.00 | 0.00 | 2.14 | 0.00 | 0.00 | 1.54 | | 0 | HGG 2 |
| 2394990 | 0.77 | 0.00 to 1.48 | 0.00 | 0.00 | 0.00 | 1.27 | 1.20 | 1.43 | 1.48 | | 0 | HGG 2 |
| 2837006 | 1.13 | 0.00 to 1.80 | 1.44 | 0.00 | 0.00 | 1.52 | 1.57 | 1.61 | 1.80 | | 0 | HGG 2 |
| 1816768 | 0.24 | 0.00 to 1.66 | 0.00 | 0.00 | 0.00 | 1.66 | 0.00 | 0.00 | 0.00 | | 0 | HGG 2 |
| 1833010 | 0.25 | 0.0o to 1.76 | 0.00 | 0.00 | 0.00 | 1.76 | 0.00 | 0.00 | 0.00 | | 0 | HGG 2 |
| 2874881 | 0.64 | 0.00 to 1.71 | 0.00 | 0.00 | 0.00 | 1.71 | 1.43 | 0.00 | 1.36 | | 0 | HGG 2 |
| 2881039 | 0.50 | 0.00 to 1.40 | 0.00 | 0.00 | 0.00 | 1.38 | 1.40 | 0.00 | 0.73 | | 0 | HGG 2 |
| 1960822 | 0.75 | 0.00 to 2.91 | 0.00 | 0.00 | 0.00 | 0.26 | 2.91 | 1.62 | 0.43 | | 0 | HGG 2 |
| 2948678 | 0.26 | 0.00 to 1.79 | 0.00 | 0.00 | 0.00 | 1.79 | 0.00 | 0.00 | 0.00 | | 0 | HGG 2 |
| 3045419 | 1.14 | 0.78 to 1.53 | 0.90 | 0.78 | 0.91 | 1.25 | 1.13 | 1.53 | 1.44 | | 0 | HGG 2 |
| 3229449 | 1.05 | 0.00 to 2.74 | 0.00 | 0.00 | 0.00 | 2.74 | 2.45 | 0.00 | 2.15 | | 0 | HGG 2 |
| 2018315 | 0.93 | 0.00 to 1.72 | 0.00 | 0.00 | 0.00 | 1.71 | 1.59 | 1.72 | 1.52 | | 0 | HGG 2 |
| 3876612 | 0.19 | 0.00 to 1.36 | 0.00 | 0.00 | 0.00 | 1.36 | 0.00 | 0.00 | 0.00 | | 0 | HGG 2 |
| 619447 | 0.33 | 0.00 to 1.37 | 0.00 | 0.00 | 0.00 | 1.37 | 0.00 | 0.00 | 0.92 | | 0 | HGG 2 |
| 2025128 | 1.20 | 0.92 to 1.44 | 1.09 | 1.02 | 0.92 | 1.44 | 1.30 | 1.38 | 1.23 | | 1 | HGG 2 |
| 2124056 | 2.11 | 1.69 to 2.57 | 2.57 | 2.30 | 2.22 | 1.98 | 1.97 | 2.06 | 1.69 | | 1 | HGG 2 |
| 1326255 | 2.91 | 2.24 to 3.67 | 3.65 | 3.67 | 3.14 | 2.68 | 2.58 | 2.42 | 2.24 | | 1 | HGG 2 |
| 1407125 | 1.71 | 1.44 to 1.85 | 1.73 | 1.59 | 1.44 | 1.85 | 1.78 | 1.75 | 1.84 | | 1 | HGG 2 |
| 1559844 | 1.32 | 0.00 to 1.69 | 1.58 | 0.00 | 1.36 | 1.47 | 1.58 | 1.59 | 1.69 | | 1 | HGG 2 |
| 1709709 | 1.49 | 1.33 to 1.70 | 1.50 | 1.33 | 1.40 | 1.51 | 1.53 | 1.70 | 1.46 | | 1 | HGG 2 |
| 2230608 | 1.30 | 1.09 to 1.47 | 1.32 | 1.09 | 1.16 | 1.47 | 1.34 | 1.43 | 1.31 | | 1 | HGG 2 |
| 3206352 | 1.78 | 1.69 to 2.03 | 1.77 | 1.74 | 1.70 | 1.76 | 1.77 | 2.03 | 1.69 | | 1 | HGG 2 |
| 1911819 | 1.50 | 1.26 to 1.95 | 1.47 | 1.26 | 1.41 | 1.95 | 1.47 | 1.48 | 1.43 | | 1 | HGG 2 |
| 660142 | 3.20 | 2.84 to 3.47 | 3.15 | 2.84 | 2.95 | 3.47 | 3.44 | 3.40 | 3.18 | | 1 | HGG 2 |
| 870396 | 1.29 | 1.06 to 1.56 | 1.19 | 1.17 | 1.06 | 1.56 | 1.32 | 1.41 | 1.33 | | 1 | HGG 2 |
| 1988540 | 1.82 | 1.31 to 2.08 | 2.08 | 1.89 | 1.85 | 1.85 | 1.95 | 1.84 | 1.31 | | 1 | HGG 2 |
| 960604 | 2.12 | 1.86 to 2.57 | 1.86 | 1.88 | 1.87 | 2.14 | 2.13 | 2.40 | 2.57 | | 1 | HGG 2 |
| 2021989 | 1.57 | 1.25 to 1.83 | 1.51 | 1.36 | 1.25 | 1.55 | 1.72 | 1.75 | 1.83 | | 1 | HGG 2 |
| 1303862 | 1.78 | 0.00 to 3.65 | 0.00 | 0.00 | 0.00 | 2.96 | 2.51 | 3.65 | 3.35 | | 2 | HGG 2 |
| 2226309 | 1.94 | 0.00 to 3.99 | 0.00 | 0.00 | 0.00 | 3.14 | 2.86 | 3.57 | 3.99 | | 2 | HGG 2 |
| 2234266 | 1.87 | 0.00 to 3.50 | 0.00 | 0.00 | 0.00 | 3.24 | 3.01 | 3.34 | 3.50 | | 2 | HGG 2 |
| 1798594 | 1.37 | 0.00 to 2.41 | 0.99 | 0.00 | 0.91 | 1.95 | 1.53 | 1.79 | 2.41 | | 2 | HGG 2 |
| 1926934 | 1.48 | 0.00 to 2.75 | 0.00 | 0.00 | 0.00 | 2.56 | 2.35 | 2.75 | 2.73 | | 2 | HGG 2 |
| 626471 | 1.37 | 0.00 to 2.85 | 0.00 | 0.00 | 0.00 | 2.85 | 2.31 | 2.24 | 2.22 | | 2 | HGG 2 |
| 2453558 | −1.02 | −1.41 to 0.00 | 0.00 | −1.00 | −1.27 | −1.15 | −1.12 | −1.19 | −1.41 | | 3 | HGG 2 |
| 1988774 | −1.12 | −1.47 to 1.49 | −0.49 | −1.31 | −1.32 | −1.14 | −0.65 | −1.44 | −1.47 | | 3 | HGG 2 |
| 3100048 | −1.00 | −1.78 to 1.07 | −1.12 | −1.07 | −1.20 | −1.27 | −0.07 | −1.50 | −1.78 | | 3 | HGG 2 |
| 2703122 | −1.38 | −1.63 to −1.25 | −1.35 | −1.37 | −1.63 | −1.25 | −1.26 | −1.42 | −1.36 | | 3 | HGG 2 |
| 2669337 | −0.70 | −1.97 to −0.24 | −0.29 | −0.24 | −0.62 | −0.55 | −0.34 | −1.97 | −0.91 | | 4 | HGG 2 |
| 2703282 | −0.85 | −1.53 to 0.00 | 0.00 | 0.00 | −0.96 | −1.05 | −0.91 | −1.53 | −1.47 | | 4 | HGG 2 |
| 2794866 | −0.75 | −1.53 to 0.00 | 0.00 | 0.00 | 0.00 | −1.33 | −0.92 | −1.49 | −1.53 | | 4 | HGG 2 |
| 1753283 | −1.18 | −1.73 to 0.00 | −1.00 | 0.00 | −1.26 | −1.58 | −1.15 | −1.73 | −1.56 | | 4 | HGG 2 |
| 1316801 | 1.97 | 0.00 to 2.98 | 0.00 | 0.00 | 2.56 | 2.98 | 2.72 | 2.86 | 2.65 | | 5 | HGG 2 |
| 1961617 | 2.18 | 0.00 to 3.54 | 0.00 | 0.00 | 2.36 | 3.04 | 2.96 | 3.37 | 3.54 | | 5 | HGG 2 |
| 2544622 | 2.46 | 0.00 to 3.82 | 0.00 | 0.00 | 3.16 | 3.39 | 3.28 | 3.82 | 3.58 | | 5 | HGG 2 |
| 1251065 | 1.37 | 1.19 to 1.52 | 1.19 | 1.30 | 1.46 | 1.34 | 1.42 | 1.52 | | | 0 | HGG 3 |
| 5322365 | 1.46 | 1.18 to 1.65 | 1.33 | 1.18 | 1.65 | 1.41 | 1.61 | 1.59 | | | 0 | HGG 3 |
| 5512044 | 1.90 | 1.60 to 2.18 | 1.60 | 1.73 | 1.95 | 1.86 | 2.06 | 2.18 | | | 0 | HGG 3 |
| 3973687 | 1.47 | 1.12 to 1.82 | 1.14 | 1.12 | 1.56 | 1.54 | 1.63 | 1.82 | | | 0 | HGG 3 |
| 4215034 | 1.50 | 0.82 to 1.99 | 0.94 | 0.82 | 1.78 | 1.65 | 1.84 | 1.99 | | | 0 | HGG 3 |
| 3158828 | 1.82 | 1.25 to 2.12 | 1.25 | 1.65 | 2.09 | 1.83 | 1.99 | 2.12 | | | 0 | HGG 3 |
| 2170820 | 1.30 | 0.75 to 1.58 | 0.75 | 0.93 | 1.58 | 1.55 | 1.49 | 1.53 | | | 0 | HGG 3 |
| 4112181 | 0.97 | 0.68 to 1.37 | 0.68 | 0.74 | 1.06 | 0.87 | 1.08 | 1.37 | | | 0 | HGG 3 |
| 2343348 | 1.96 | 1.66 to 2.18 | 1.76 | 1.66 | 2.06 | 1.98 | 2.11 | 2.18 | | | 0 | HGG 3 |
| 4312860 | 1.14 | 0.83 to 1.48 | 0.83 | 1.13 | 0.91 | 1.30 | 1.18 | 1.48 | | | 0 | HGG 3 |
| 4373333 | 1.12 | 0.70 to 1.38 | 0.78 | 0.70 | 1.38 | 1.25 | 1.30 | 1.32 | | | 0 | HGG 3 |
| 2660756 | 1.26 | 0.90 to 1.51 | 0.90 | 1.08 | 1.51 | 1.19 | 1.42 | 1.48 | | | 0 | HGG 3 |
| 2687356 | 1.23 | 0.85 to 1.40 | 0.85 | 1.18 | 1.36 | 1.30 | 1.40 | 1.31 | | | 0 | HGG 3 |

TABLE 13-continued

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 3495173 | 1.67 | 1.35 to 1.98 | 1.53 | 1.35 | 1.89 | 1.50 | 1.79 | 1.98 | | | 0 | HGG 3 |
| 2972013 | 1.63 | 1.27 to 1.94 | 1.28 | 1.27 | 1.73 | 1.71 | 1.87 | 1.94 | | | 0 | HGG 3 |
| 3034889 | 1.64 | 1.40 to 1.77 | 1.54 | 1.40 | 1.77 | 1.63 | 1.77 | 1.73 | | | 0 | HGG 3 |
| 4855265 | 1.24 | 0.80 to 1.53 | 0.80 | 1.08 | 1.33 | 1.26 | 1.46 | 1.53 | | | 0 | HGG 3 |
| 5266376 | 1.38 | 1.06 to 1.67 | 1.15 | 1.06 | 1.50 | 1.48 | 1.67 | 1.42 | | | 0 | HGG 3 |
| 5293028 | 1.34 | 0.99 to 1.66 | 1.66 | 0.99 | 1.40 | 1.07 | 1.44 | 1.45 | | | 0 | HGG 3 |
| 1560380 | 0.92 | 0.00 to 1.97 | 1.62 | 0.00 | 1.96 | 0.00 | 0.00 | 1.97 | | | 1 | HGG 3 |
| 538427 | 0.69 | 0.00 to 1.49 | 1.49 | 0.00 | 1.29 | 0.00 | 0.00 | 1.35 | | | 1 | HGG 3 |
| 4232507 | 0.74 | 0.00 to 1.83 | 1.19 | 0.00 | 1.42 | 0.00 | 0.00 | 1.83 | | | 1 | HGG 3 |
| 3068978 | 0.60 | 0.00 to 1.87 | 0.00 | 0.00 | 1.73 | 0.00 | 0.00 | 1.87 | | | 1 | HGG 3 |
| 1831454 | 0.63 | 0.00 to 1.36 | 1.24 | 0.00 | 1.36 | 0.00 | 0.00 | 1.20 | | | 1 | HGG 3 |
| 2195427 | 0.48 | 0.00 to 1.45 | 0.00 | 0.00 | 1.45 | 0.00 | 0.00 | 1.44 | | | 1 | HGG 3 |
| 2343836 | 0.63 | 0.00 to 1.50 | 0.83 | 0.00 | 1.50 | 0.00 | 0.00 | 1.44 | | | 1 | HGG 3 |
| 2545486 | 0.96 | 0.00 to 1.55 | 1.32 | 0.00 | 1.48 | 1.38 | 0.00 | 1.55 | | | 1 | HGG 3 |
| 4247396 | 0.78 | 0.00 to 1.72 | 1.72 | 0.00 | 1.55 | 0.00 | 0.00 | 1.41 | | | 1 | HGG 3 |
| 3528232 | 0.80 | 0.00 to 1.75 | 1.75 | 0.00 | 1.39 | 0.00 | 0.00 | 1.65 | | | 1 | HGG 3 |
| 4508879 | 0.95 | 0.00 to 2.11 | 1.64 | 0.00 | 1.92 | 0.00 | 0.00 | 2.11 | | | 1 | HGG 3 |
| 664625 | 0.74 | 0.00 to 1.68 | 1.19 | 0.00 | 1.56 | 0.00 | 0.00 | 1.68 | | | 1 | HGG 3 |
| 699113 | 1.22 | 0.00 to 3.18 | 3.18 | 0.00 | 1.90 | 0.00 | 0.00 | 2.25 | | | 1 | HGG 3 |
| 3090808 | −0.99 | −1.37 to −0.37 | −0.83 | −0.37 | −1.37 | −0.93 | −1.14 | −1.32 | | | 2 | HGG 3 |
| 3120209 | −0.99 | −1.82 to −0.43 | −1.16 | −1.82 | −0.43 | −1.10 | −0.82 | −0.63 | | | 2 | HGG 3 |
| 3135460 | −1.04 | −1.51 to −0.59 | −0.97 | −0.59 | −1.43 | −0.79 | −0.96 | −1.51 | | | 2 | HGG 3 |
| 5166479 | −1.36 | −1.58 to −0.87 | −1.58 | −1.47 | −1.37 | −0.87 | −1.49 | −1.38 | | | 2 | HGG 3 |
| 3778404 | −1.50 | −1.75 to −1.19 | −1.72 | −1.19 | −1.75 | −1.28 | −1.43 | −1.63 | | | 2 | HGG 3 |
| 5573549 | −1.35 | −1.48 to −1.08 | −1.08 | −1.45 | −1.48 | −1.39 | −1.30 | −1.40 | | | 2 | HGG 3 |
| 5427710 | −1.82 | −2.23 to −1.48 | −1.55 | −1.48 | −1.84 | −1.81 | −2.23 | | | | 2 | HGG 3 |
| 5399371 | −0.78 | −1.33 to −0.35 | −0.79 | −1.33 | −0.91 | −0.62 | −0.35 | −0.72 | | | 2 | HGG 3 |
| 4289557 | −1.79 | −2.17 to −1.54 | −1.78 | −1.68 | −1.82 | −1.54 | −1.75 | −2.17 | | | 2 | HGG 3 |
| 3084204 | −1.38 | −1.56 to −1.21 | −1.31 | −1.46 | −1.44 | −1.21 | −1.28 | −1.56 | | | 2 | HGG 3 |
| 3729593 | 0.55 | 0.00 to 1.41 | 1.41 | 0.00 | 0.97 | 0.00 | 0.00 | 0.93 | | | 3 | HGG 3 |
| 3967255 | 0.23 | 0.00 to 1.40 | 1.40 | 0.00 | 0.00 | 0.00 | 0.00 | 0.00 | | | 3 | HGG 3 |
| 4606503 | 0.50 | 0.00 to 1.75 | 0.73 | 1.75 | 0.49 | 0.00 | 0.00 | 0.00 | | | 3 | HGG 3 |
| 5186846 | 0.11 | −0.39 to 1.98 | 1.98 | −0.39 | −0.29 | −0.27 | −0.24 | −0.16 | | | 3 | HGG 3 |
| 5206821 | 0.50 | 0.00 to 1.39 | 1.39 | 0.00 | 0.80 | 0.00 | 0.00 | 0.84 | | | 3 | HGG 3 |
| 554654 | 0.63 | 0.33 to 1.60 | 1.60 | 0.36 | 0.48 | 0.33 | 0.53 | 0.45 | | | 3 | HGG 3 |
| 3369213 | 0.29 | 0.00 to 1.44 | 1.44 | 0.00 | 0.22 | 0.00 | 0.00 | 0.08 | | | 3 | HGG 3 |
| 3410101 | 0.31 | 0.00 to 1.87 | 1.87 | 0.00 | 0.00 | 0.00 | 0.00 | 0.00 | | | 3 | HGG 3 |
| 854872 | 0.44 | 0.00 to 1.69 | 0.96 | 0.00 | 0.00 | 0.00 | 0.00 | 1.69 | | | 3 | HGG 3 |
| 5508135 | 1.38 | 0.00 to 1.87 | 1.50 | 0.00 | 1.62 | 1.61 | 1.87 | 1.69 | | | 4 | HGG 3 |
| 1697855 | 0.85 | 0.00 to 1.56 | 0.96 | 0.00 | 0.94 | 0.58 | 1.05 | 1.56 | | | 4 | HGG 3 |
| 615776 | 1.11 | 0.00 to 1.60 | 0.90 | 0.00 | 1.35 | 1.24 | 1.56 | 1.60 | | | 4 | HGG 3 |
| 621543 | 1.52 | 0.00 to 2.08 | 1.26 | 0.00 | 1.91 | 2.03 | 1.81 | 2.08 | | | 4 | HGG 3 |
| 5094042 | 0.98 | 0.00 to 1.46 | 0.50 | 0.00 | 1.32 | 1.29 | 1.34 | 1.46 | | | 4 | HGG 3 |
| 3974247 | 1.47 | 0.00 to 2.06 | 1.34 | 0.00 | 1.90 | 1.66 | 1.83 | 2.06 | | | 4 | HGG 3 |
| 689296 | 1.12 | 0.45 to 1.45 | 0.72 | 0.45 | 1.44 | 1.45 | 1.34 | 1.35 | | | 4 | HGG 3 |
| 2871076 | 1.25 | 0.00 to 1.82 | 1.15 | 0.00 | 1.82 | 1.24 | 1.50 | 1.80 | | | 4 | HGG 3 |
| 1786554 | 1.29 | 0.00 to 1.78 | 1.51 | 0.00 | 1.71 | 1.35 | 1.39 | 1.78 | | | 4 | HGG 3 |
| 4402555 | 2.40 | 1.80 to 2.66 | 1.80 | 2.39 | 2.64 | 2.33 | 2.66 | 2.56 | | | 5 | HGG 3 |
| 3172265 | 3.82 | 3.69 to 4.07 | 4.07 | 3.69 | 3.71 | 3.70 | 3.89 | 3.84 | | | 5 | HGG 3 |
| 5266015 | 2.42 | 2.12 to 2.69 | 2.12 | 2.36 | 2.51 | 2.44 | 2.69 | 2.42 | | | 5 | HGG 3 |
| 4253809 | 2.14 | 1.87 to 2.30 | 1.96 | 1.87 | 2.24 | 2.24 | 2.26 | 2.30 | | | 5 | HGG 3 |
| 4912315 | 2.23 | 1.90 to 2.40 | 2.06 | 2.27 | 2.36 | 1.90 | 2.39 | 2.40 | | | 5 | HGG 3 |
| 3069190 | 3.66 | 3.51 to 3.89 | 3.52 | 3.51 | 3.57 | 3.63 | 3.89 | 3.84 | | | 5 | HGG 3 |
| 3957354 | 2.57 | 0.00 to 3.46 | 2.96 | 0.00 | 3.16 | 2.75 | 3.09 | 3.46 | | | 6 | HGG 3 |
| 1661892 | 1.61 | 0.00 to 2.85 | 0.70 | 0.00 | 2.27 | 1.90 | 1.97 | 2.85 | | | 6 | HGG 3 |
| 5102731 | 1.77 | 0.00 to 2.42 | 1.59 | 0.00 | 2.40 | 2.13 | 2.42 | 2.08 | | | 6 | HGG 3 |
| 3074113 | 2.00 | 0.00 to 2.75 | 1.86 | 0.00 | 2.45 | 2.40 | 2.53 | 2.75 | | | 6 | HGG 3 |
| 872107 | 1.63 | 0.00 to 2.19 | 1.45 | 0.00 | 2.02 | 2.00 | 2.10 | 2.19 | | | 6 | HGG 3 |
| 2110482 | 1.36 | 0.97 to 1.56 | 0.97 | 1.11 | 1.56 | 1.53 | 1.54 | 1.46 | | | 0 | HGG 4 |
| 2196870 | 1.35 | 1.23 to 1.41 | 1.33 | 1.41 | 1.36 | 1.34 | 1.40 | 1.23 | | | 0 | HGG 4 |
| 2756587 | 1.26 | 1.16 to 1.36 | 1.16 | 1.27 | 1.25 | 1.36 | 1.32 | 1.21 | | | 0 | HGG 4 |
| 2267466 | 1.20 | 0.00 to 1.55 | 1.55 | 1.49 | 1.43 | 1.41 | 0.00 | 1.31 | | | 0 | HGG 4 |
| 1448572 | 1.20 | 0.97 to 1.49 | 1.17 | 1.12 | 0.97 | 1.49 | 1.42 | 1.05 | | | 0 | HGG 4 |
| 3016137 | 1.26 | 0.85 to 2.05 | 2.05 | 1.77 | 0.91 | 0.91 | 1.08 | 0.85 | | | 0 | HGG 4 |
| 3149570 | 1.41 | 1.22 to 1.52 | 1.40 | 1.38 | 1.49 | 1.47 | 1.52 | 1.22 | | | 0 | HGG 4 |
| 417432 | 1.35 | 1.13 to 1.48 | 1.39 | 1.47 | 1.48 | 1.29 | 1.34 | 1.13 | | | 0 | HGG 4 |
| 4738532 | 1.37 | 1.15 to 1.53 | 1.15 | 1.30 | 1.37 | 1.39 | 1.53 | 1.46 | | | 0 | HGG 4 |
| 1730026 | 1.32 | 1.21 to 1.46 | 1.23 | 1.24 | 1.46 | 1.43 | 1.35 | 1.21 | | | 0 | HGG 4 |
| 5101167 | 1.31 | 1.10 to 1.60 | 1.10 | 1.21 | 1.41 | 1.31 | 1.60 | 1.25 | | | 0 | HGG 4 |
| 2404746 | 1.46 | 1.13 to 1.94 | 1.89 | 1.94 | 1.13 | 1.24 | 1.24 | 1.34 | | | 0 | HGG 4 |
| 1951845 | 1.02 | 0.00 to 1.43 | 1.43 | 1.28 | 1.17 | 0.00 | 1.21 | 1.01 | | | 0 | HGG 4 |
| 2405487 | 1.27 | 1.18 to 1.38 | 1.20 | 1.18 | 1.35 | 1.29 | 1.38 | 1.21 | | | 0 | HGG 4 |
| 2408333 | 1.36 | 1.00 to 1.78 | 1.78 | 1.70 | 1.16 | 1.13 | 1.37 | 1.00 | | | 0 | HGG 4 |

TABLE 13-continued

| Clone ID | Ave DE t/Betam | Range | mean DE t/Betam 1 μM, 1 hr | mean DE t/Betam 1 μM, 3 hr | mean DE t/Betam 1 μM, 6 hr | mean DE t/Betam 10 μM, 1 hr | mean DE t/Betam 10 μM, 6 hr | mean DE t/Betam 100 μM, 1 hr | mean DE t/Betam 100 μM, 3 hr | mean DE t/Betam 100 μM, 6 hr | Cluster | GEM |
|---|---|---|---|---|---|---|---|---|---|---|---|---|
| 1965856 | 1.45 | 1.37 to 1.52 | 1.37 | 1.48 | 1.51 | 1.42 | 1.52 | 1.41 | | | 0 | HGG 4 |
| 2006043 | 1.35 | 1.14 to 1.46 | 1.38 | 1.46 | 1.44 | 1.31 | 1.41 | 1.14 | | | 0 | HGG 4 |
| 2410066 | 1.27 | 1.17 to 1.38 | 1.25 | 1.20 | 1.34 | 1.28 | 1.38 | 1.17 | | | 0 | HGG 4 |
| 2619275 | 1.42 | 1.28 to 1.57 | 1.28 | 1.34 | 1.50 | 1.57 | 1.50 | 1.30 | | | 0 | HGG 4 |
| 2734007 | 1.04 | 0.86 to 1.47 | 0.95 | 0.87 | 0.86 | 1.47 | 1.13 | 0.98 | | | 0 | HGG 4 |
| 2751922 | 1.24 | 1.08 to 1.55 | 1.18 | 1.10 | 1.08 | 1.55 | 1.39 | 1.12 | | | 0 | HGG 4 |
| 1323327 | 1.00 | 0.00 to 1.69 | 1.69 | 1.61 | 1.37 | 0.00 | 0.00 | 1.32 | | | 1 | HGG |
| 1329625 | 0.91 | 0.00 to 1.52 | 1.52 | 1.47 | 1.10 | 0.00 | 0.00 | 1.36 | | | 1 | HGG 4 |
| 2271648 | 0.33 | 0.00 to 1.38 | 1.38 | 0.00 | 0.27 | 0.00 | 0.00 | 0.34 | | | 1 | HGG 4 |
| 4000614 | 0.50 | 0.00 to 1.49 | 1.49 | 0.00 | 0.71 | 0.00 | 0.00 | 0.79 | | | 1 | HGG 4 |
| 3686411 | 0.41 | −0.02 to 1.56 | 0.85 | 0.00 | 0.05 | 0.00 | 1.56 | −0.02 | | | 1 | HGG 4 |
| 1495730 | 0.47 | 0.00 to 1.57 | 0.00 | 0.00 | 1.27 | 0.00 | 0.00 | 1.57 | | | 1 | HGG 4 |
| 1496011 | 0.60 | 0.00 to 1.38 | 1.38 | 0.00 | 1.03 | 0.00 | 0.00 | 1.16 | | | 1 | HGG 4 |
| 1600180 | 0.77 | 0.00 to 1.68 | 1.68 | 0.00 | 1.29 | 0.00 | 0.00 | 1.62 | | | 1 | HGG 4 |
| 3508345 | 0.46 | 0.00 to 1.35 | 1.35 | 0.00 | 0.64 | 0.00 | 0.00 | 0.78 | | | 1 | HGG 4 |
| 2273619 | 0.36 | 0.00 to 1.33 | 1.33 | 0.00 | 0.39 | 0.00 | 0.00 | 0.44 | | | 1 | HGG 4 |
| 2430165 | 0.68 | 0.00 to 1.50 | 1.50 | 0.00 | 1.29 | 0.00 | 0.00 | 1.28 | | | 1 | HGG 4 |
| 2933127 | 0.49 | 0.00 to 1.35 | 1.35 | 0.00 | 0.82 | 0.00 | 0.00 | 0.74 | | | 1 | HGG 4 |
| 2276895 | 0.66 | 0.00 to 1.43 | 1.43 | 1.10 | 0.77 | 0.00 | 0.00 | 0.67 | | | 1 | HGG 4 |
| 2915217 | 0.84 | 0.00 to 1.51 | 1.46 | 1.51 | 0.74 | 0.78 | 0.00 | 0.55 | | | 1 | HGG 4 |
| 278939 | 0.39 | 0.00 to 1.37 | 1.37 | 0.00 | 0.51 | 0.00 | 0.00 | 0.45 | | | 1 | HGG 4 |
| 2407620 | 0.02 | −1.38 to 0.77 | 0.77 | 0.44 | 0.23 | 0.00 | −1.38 | 0.03 | | | 1 | HGG 4 |
| 220378 | 0.57 | 0.00 to 1.44 | 1.44 | 0.00 | 1.02 | 0.00 | 0.00 | 0.97 | | | 1 | HGG 4 |
| 2753065 | 0.75 | 0.00 to 1.92 | 1.92 | 0.00 | 1.43 | 0.00 | 0.00 | 1.14 | | | 1 | HGG 4 |
| 2753963 | 0.34 | 0.00 to 1.36 | 1.36 | 0.00 | 0.37 | 0.00 | 0.00 | 0.32 | | | 1 | HGG 4 |
| 964939 | 0.53 | 0.00 to 1.34 | 1.34 | 0.92 | 0.51 | 0.00 | 0.00 | 0.43 | | | 1 | HGG 4 |
| 2106010 | 1.56 | 1.27 to 1.68 | 1.55 | 1.60 | 1.68 | 1.67 | 1.59 | 1.27 | | | 2 | HGG 4 |
| 2350594 | 1.53 | 1.29 to 1.74 | 1.29 | 1.46 | 1.56 | 1.74 | 1.73 | 1.43 | | | 2 | HGG 4 |
| 2669871 | 1.59 | 1.22 to 2.12 | 1.42 | 1.39 | 1.58 | 1.22 | 1.83 | 2.12 | | | 2 | HGG 4 |
| 3522739 | 1.61 | 1.44 to 1.86 | 1.44 | 1.62 | 1.55 | 1.44 | 1.86 | 1.78 | | | 2 | HGG 4 |
| 434751 | 1.73 | 1.51 to 1.89 | 1.56 | 1.51 | 1.84 | 1.75 | 1.83 | 1.89 | | | 2 | HGG 4 |
| 1365045 | 1.93 | 1.80 to 2.12 | 1.80 | 1.92 | 1.93 | 1.99 | 2.12 | 1.80 | | | 2 | HGG 4 |
| 509839 | 2.02 | 1.79 to 2.16 | 1.81 | 1.79 | 2.16 | 2.04 | 2.15 | 2.15 | | | 2 | HGG 4 |
| 1913334 | 1.50 | 1.25 to 1.65 | 1.25 | 1.38 | 1.58 | 1.62 | 1.65 | 1.51 | | | 2 | HGG 4 |
| 5690026 | 1.65 | 1.57 to 1.78 | 1.57 | 1.68 | 1.78 | 1.67 | 1.62 | 1.59 | | | 2 | HGG 4 |
| 2007730 | 1.52 | 1.17 to 1.91 | 1.17 | 1.29 | 1.61 | 1.65 | 1.91 | 1.47 | | | 2 | HGG 4 |
| 2581075 | 3.94 | 3.80 to 4.14 | 3.91 | 3.88 | 3.95 | 3.80 | 4.14 | 3.99 | | | 3 | HGG 4 |
| 3191030 | 2.58 | 2.20 to 2.99 | 2.36 | 2.20 | 2.75 | 2.36 | 2.99 | 2.83 | | | 3 | HGG 4 |
| 2013251 | 2.32 | 2.11 to 2.53 | 2.11 | 2.16 | 2.49 | 2.29 | 2.53 | 2.31 | | | 3 | HGG 4 |
| 1964758 | 2.31 | 2.16 to 2.44 | 2.22 | 2.29 | 2.37 | 2.44 | 2.37 | 2.16 | | | 3 | HGG 4 |
| 2278772 | 2.51 | 2.03 to 2.87 | 2.87 | 2.72 | 2.36 | 2.03 | 2.63 | 2.48 | | | 3 | HGG 4 |
| 1370137 | 2.86 | 2.77 to 2.97 | 2.77 | 2.80 | 2.93 | 2.81 | 2.97 | 2.90 | | | 3 | HGG 4 |
| 3042227 | −1.53 | −1.64 to −1.35 | −1.35 | −1.62 | −1.64 | −1.60 | −1.56 | −1.40 | | | 4 | HGG 4 |
| 1857850 | −2.00 | −2.38 to −1.71 | −1.71 | −2.05 | −1.98 | −1.90 | −2.00 | −2.38 | | | 4 | HGG 4 |
| 2786442 | −1.36 | −1.62 to −1.13 | −1.36 | −1.33 | −1.25 | −1.62 | −1.45 | −1.13 | | | 4 | HGG 4 |
| 1449819 | −1.51 | −2.02 to −0.50 | −1.58 | −2.02 | −1.75 | −0.50 | −1.45 | −1.79 | | | 4 | HGG 4 |
| 2055569 | −0.86 | −1.38 to −0.27 | −0.73 | −1.38 | −1.00 | −0.27 | −0.61 | −1.15 | | | 4 | HGG 4 |
| 195943 | 0.48 | −0.23 to 3.17 | 3.17 | 0.24 | −0.23 | −0.09 | −0.09 | −0.14 | | | 5 | HGG 4 |
| 309006 | 0.78 | 0.29 to 2.29 | 2.29 | 0.58 | 0.29 | 0.56 | 0.56 | 0.40 | | | 5 | HGG 4 |

TABLE 14

| Clone ID | Ave De t/ Danazol | Range | mean DE t/ Danazol 1 μM, 1 hr | mean DE t/ Danazol 1 μM, 3 hr | mean DE t/ Danazol 1 μM, 6 hr | mean DE t/ Danazol 10 μM, 1 hr | mean DE t/ Danazol 10 μM, 3 hr | mean DE t/ Danazol 10 μM, 6 hr | mean DE t/ Danazol 100 μM, 1 hr | mean DE t/ Danazol 100 μM, 3 hr | mean DE t/ Danazol 100 μM, 6 hr | Cluster | GEM |
|---|---|---|---|---|---|---|---|---|---|---|---|---|---|
| 960496 | −0.34 | −2.51 to 0.13 | 0.06 | 0.09 | −0.07 | 0.00 | −0.19 | 0.13 | 0.00 | −2.51 | −0.52 | 0 | HGG 1 |
| 1219506 | −0.36 | −2.91 to 0.04 | −0.04 | 0.04 | −0.02 | −0.06 | −0.15 | 0.00 | 0.00 | −2.91 | −0.09 | 0 | HGG 1 |
| 3278632 | −0.16 | −1.49 to 0.34 | 0.34 | 0.12 | −0.20 | 0.09 | −0.24 | 0.00 | 0.00 | −1.49 | −0.08 | 0 | HGG 1 |
| 932244 | −0.31 | −2.80 to 0.00 | 0.00 | 0.00 | 0.00 | 0.00 | 0.00 | 0.00 | 0.00 | −2.80 | 0.00 | 0 | HGG 1 |
| 5405691 | −0.26 | −2.67 to 0.47 | 0.47 | 0.00 | −0.10 | 0.00 | 0.00 | 0.00 | 0.00 | −2.67 | 0.00 | 0 | HGG 1 |
| 5326338 | −0.34 | −2.70 to 0.05 | 0.03 | 0.05 | 0.03 | 0.00 | −0.16 | −0.17 | 0.00 | −2.70 | −0.11 | 0 | HGG 1 |
| 1310337 | −0.20 | −1.43 to 0.07 | 0.03 | −0.08 | −0.06 | −0.03 | −0.15 | −0.20 | 0.00 | −1.43 | 0.07 | 0 | HGG 1 |
| 2444740 | −0.24 | −2.12 to 0.00 | 0.00 | 0.00 | 0.00 | 0.00 | 0.00 | 0.00 | 0.00 | −2.12 | 0.00 | 0 | HGG 1 |
| 4110976 | −0.36 | −3.24 to 0.00 | 0.00 | 0.00 | 0.00 | 0.00 | 0.00 | 0.00 | 0.00 | −3.24 | 0.00 | 0 | HGG 1 |
| 5207486 | −0.24 | −1.66 to 0.13 | 0.13 | 0.06 | −0.12 | −0.04 | −0.11 | −0.21 | −0.07 | −1.66 | −0.13 | 0 | HGG 1 |
| 3474091 | −0.29 | −2.01 to 0.25 | 0.25 | 0.00 | −0.05 | 0.00 | −0.27 | 0.00 | 0.00 | −2.01 | −0.55 | 0 | HGG 1 |

TABLE 14-continued

| Clone ID | Ave De t/ Danazol | Range | mean DE t/ Danazol 1 μM, 1 hr | mean DE t/ Danazol 1 μM, 3 hr | mean DE t/ Danazol 1 μM, 6 hr | mean DE t/ Danazol 10 μM, 1 hr | mean DE t/ Danazol 10 μM, 3 hr | mean DE t/ Danazol 10 μM, 6 hr | mean DE t/ Danazol 100 μM, 1 hr | mean DE t/ Danazol 100 μM, 3 hr | mean DE t/ Danazol 100 μM, 6 hr | Cluster | GEM |
|---|---|---|---|---|---|---|---|---|---|---|---|---|---|
| 2927479 | −0.34 | −1.49 to 0.04 | 0.04 | −0.19 | −0.26 | −0.03 | −0.37 | 0.00 | −0.33 | −1.49 | −0.40 | 0 | HGG 1 |
| 4759669 | −0.27 | −2.64 to 0.31 | 0.31 | 0.04 | −0.05 | 0.08 | −0.27 | 0.02 | 0.00 | −2.64 | 0.07 | 0 | HGG 1 |
| 2203570 | −0.29 | −2.60 to 0.00 | 0.00 | 0.00 | 0.00 | 0.00 | 0.00 | 0.00 | 0.00 | −2.60 | 0.00 | 0 | HGG 1 |
| 4741591 | −0.41 | −2.48 to 0.00 | −0.10 | −0.05 | −0.27 | −0.18 | −0.27 | 0.00 | 0.00 | −2.48 | −0.34 | 0 | HGG 1 |
| 1638756 | −0.18 | −1.47 to 0.13 | 0.07 | −0.15 | 0.12 | −0.27 | −0.03 | 0.00 | 0.00 | −1.47 | 0.13 | 0 | HGG 1 |
| 4587665 | −0.20 | −1.74 to 0.16 | 0.16 | 0.02 | −0.05 | 0.02 | −0.20 | −0.18 | 0.00 | −1.74 | 0.13 | 0 | HGG 1 |
| 4292488 | −0.35 | −2.07 to 0.00 | −0.01 | −0.16 | −0.22 | −0.21 | −0.32 | 0.00 | 0.00 | −2.07 | −0.15 | 0 | HGG 1 |
| 997480 | −0.24 | −2.29 to 0.13 | 0.13 | 0.01 | 0.08 | 0.10 | −0.09 | 0.00 | 0.00 | −2.29 | −0.07 | 0 | HGG 1 |
| 1328741 | −0.39 | −1.82 to −0.11 | −0.11 | −0.18 | −0.16 | −0.22 | −0.18 | −0.24 | −0.49 | −0.13 | −1.82 | 1 | HGG 1 |
| 1350683 | −0.16 | −1.60 to 0.18 | 0.00 | 0.00 | 0.18 | 0.00 | 0.00 | 0.00 | 0.00 | 0.00 | −1.60 | 1 | HGG 1 |
| 1500810 | −0.41 | −2.02 to 0.02 | −0.21 | −0.27 | −0.40 | 0.02 | −0.05 | −0.19 | −0.05 | −0.54 | −2.02 | 1 | HGG 1 |
| 1506930 | −0.25 | −2.34 to 0.07 | 0.07 | 0.00 | 0.00 | 0.00 | 0.00 | 0.00 | 0.00 | 0.00 | −2.34 | 1 | HGG 1 |
| 1518310 | −0.47 | −2.62 to 0.00 | −0.22 | −0.70 | −0.69 | 0.00 | 0.00 | 0.00 | 0.00 | 0.00 | −2.62 | 1 | HGG 1 |
| 1802939 | −0.33 | −1.66 to 0.00 | −0.10 | −0.16 | −0.16 | 0.00 | −0.32 | −0.27 | 0.00 | −0.31 | −1.66 | 1 | HGG 1 |
| 1804503 | −0.44 | −1.94 to −0.13 | −0.19 | −0.13 | −0.17 | −0.30 | −0.25 | −0.25 | −0.31 | −0.46 | −1.94 | 1 | HGG 1 |
| 1853116 | −0.55 | −1.76 to −0.29 | −0.46 | −0.32 | −0.31 | −0.41 | −0.29 | −0.42 | −0.39 | −0.55 | −1.76 | 1 | HGG 1 |
| 1904987 | −0.35 | −1.49 to −0.10 | −0.36 | −0.20 | −0.16 | −0.22 | −0.10 | −0.20 | −0.22 | −0.22 | −1.49 | 1 | HGG 1 |
| 2158674 | −0.42 | −1.92 to 0.00 | −0.07 | −0.28 | −0.36 | 0.00 | −0.23 | −0.52 | −0.16 | −0.24 | −1.92 | 1 | HGG 1 |
| 2174951 | −0.16 | −1.49 to 0.28 | 0.28 | 0.08 | −0.14 | 0.00 | −0.21 | 0.00 | 0.00 | 0.00 | −1.49 | 1 | HGG 1 |
| 2216323 | −0.42 | −1.41 to −0.03 | −0.23 | −0.53 | −0.46 | −0.03 | −0.37 | −0.33 | −0.08 | −0.36 | −1.41 | 1 | HGG 1 |
| 2500872 | −0.23 | −1.68 to 0.06 | 0.06 | −0.08 | −0.12 | 0.00 | −0.28 | 0.00 | 0.00 | 0.00 | −1.68 | 1 | HGG 1 |
| 2794808 | −0.53 | −4.31 to 0.39 | 0.39 | −0.39 | −0.44 | 0.00 | 0.00 | 0.00 | 0.00 | 0.00 | −4.31 | 1 | HGG 1 |
| 2956670 | −0.35 | −3.15 to 0.00 | 0.00 | 0.00 | 0.00 | 0.00 | 0.00 | 0.00 | 0.00 | 0.00 | −3.15 | 1 | HGG 1 |
| 322933 | −0.29 | −2.64 to 0.00 | 0.00 | 0.00 | 0.00 | 0.00 | 0.00 | 0.00 | 0.00 | 0.00 | −2.64 | 1 | HGG 1 |
| 389558 | −0.37 | −1.62 to 0.00 | −0.27 | −0.39 | −0.18 | −0.23 | −0.32 | 0.00 | −0.36 | 0.00 | −1.62 | 1 | HGG 1 |
| 746910 | −0.19 | −1.88 to 0.21 | 0.21 | −0.07 | 0.00 | 0.00 | 0.00 | 0.00 | 0.00 | 0.00 | −1.88 | 1 | HGG 1 |
| 1269921 | −0.39 | −3.49 to 0.00 | 0.00 | 0.00 | 0.00 | 0.00 | 0.00 | 0.00 | 0.00 | 0.00 | −3.49 | 1 | HGG 1 |
| 1715374 | −0.78 | −1.40 to 0.04 | 0.04 | −0.76 | −1.10 | −0.15 | −0.81 | −1.40 | −0.58 | −0.89 | −1.36 | 2 | HGG 1 |
| 2055867 | −0.50 | −1.71 to 0.19 | 0.17 | −0.92 | −0.01 | 0.19 | −1.24 | −0.09 | −0.16 | −1.71 | −0.77 | 2 | HGG 1 |
| 1833362 | −0.64 | −1.41 to −0.30 | −0.50 | −0.37 | −0.63 | −0.30 | −0.48 | −0.60 | −0.46 | −1.00 | −1.41 | 2 | HGG 1 |
| 3715059 | −0.77 | −1.34 to −0.08 | −0.10 | −0.88 | −0.85 | −0.08 | −1.17 | −1.12 | −0.23 | −1.34 | −1.21 | 2 | HGG 1 |
| 5208013 | −0.51 | −1.33 to −0.03 | −0.17 | −0.22 | −0.69 | −0.03 | −0.44 | −0.74 | −0.19 | −0.81 | −1.33 | 2 | HGG 1 |
| 2890141 | −0.70 | −1.46 to −0.19 | −0.19 | −0.51 | −1.09 | −0.31 | −1.05 | −0.42 | −0.76 | −1.46 | 2 | HGG 1 |
| 1807155 | −0.71 | −1.49 to 0.02 | 0.02 | −0.79 | −0.60 | −0.24 | −1.17 | −0.71 | −0.24 | −1.49 | −1.21 | 2 | HGG 1 |
| 5047895 | −0.95 | −1.99 to −0.03 | −0.03 | −1.07 | −1.10 | −0.05 | −1.08 | −1.20 | −0.05 | −1.96 | −1.99 | 2 | HGG 1 |
| 1781411 | −0.74 | −1.57 to −0.24 | −0.24 | −0.57 | −0.46 | −0.59 | −0.87 | −0.57 | −0.75 | −1.57 | −1.03 | 2 | HGG 1 |
| 4408943 | −0.92 | −1.82 to −0.13 | −0.35 | −1.06 | −0.82 | −0.13 | −1.33 | −0.77 | −0.55 | −1.82 | −1.40 | 2 | HGG 1 |
| 120110 | −0.62 | −1.54 to 0.01 | 0.01 | −0.57 | −0.33 | −0.24 | −0.74 | −0.76 | −0.25 | −1.54 | −1.19 | 2 | HGG 1 |
| 4287327 | 1.27 | 0.26 to 2.12 | 0.40 | 1.91 | 1.42 | 0.42 | 1.99 | 1.30 | 0.26 | 2.12 | 1.60 | 3 | HGG 1 |
| 1513566 | 0.76 | 0.10 to 1.51 | 0.10 | 0.79 | 0.79 | 0.13 | 1.26 | 0.97 | 0.32 | 1.51 | 0.92 | 3 | HGG 1 |
| 4858420 | 0.78 | 0.20 to 1.54 | 0.28 | 0.76 | 0.79 | 0.40 | 1.54 | 0.80 | 0.20 | 1.37 | 0.86 | 3 | HGG 1 |
| 4896168 | 0.44 | −0.31 to 1.46 | −0.31 | 0.32 | 1.08 | −0.31 | 0.46 | 1.46 | −0.18 | 0.17 | 1.27 | 3 | HGG 1 |
| 5033671 | 0.48 | −0.53 to 1.62 | −0.53 | 0.25 | 1.48 | −0.30 | 0.61 | 1.62 | −0.38 | 0.07 | 1.53 | 3 | HGG 1 |
| 5038177 | 0.74 | 0.21 to 1.57 | 0.21 | 0.70 | 0.65 | 0.24 | 1.33 | 0.85 | 0.37 | 1.57 | 0.79 | 3 | HGG 1 |
| 1405844 | 0.49 | −0.35 to 1.42 | 0.14 | 0.99 | 1.42 | 0.25 | 1.29 | 0.65 | −0.35 | 0.00 | 0.06 | 3 | HGG 1 |
| 1308729 | 0.85 | 0.22 to 1.65 | 0.22 | 0.86 | 0.85 | 0.33 | 1.54 | 1.01 | 0.28 | 1.65 | 0.96 | 3 | HGG 1 |
| 1299246 | 0.79 | 0.11 to 1.77 | 0.11 | 0.85 | 0.58 | 0.16 | 1.41 | 1.00 | 0.33 | 1.77 | 0.87 | 3 | HGG 1 |
| 279898 | 1.83 | 0.40 to 2.85 | 0.40 | 2.51 | 2.12 | 0.83 | 2.67 | 2.10 | 0.79 | 2.85 | 2.24 | 3 | HGG 1 |
| 3724351 | −0.14 | −1.44 to 0.30 | 0.30 | −0.01 | −0.10 | −1.44 | 0.00 | 0.00 | 0.00 | 0.00 | 0.00 | 4 | HGG 1 |
| 2327230 | −0.37 | −1.56 to 0.17 | 0.17 | −0.37 | −0.70 | −0.34 | −0.49 | 0.00 | −1.56 | 0.00 | 0.00 | 4 | HGG 1 |
| 1274378 | −0.25 | −2.28 to 0.00 | 0.00 | 0.00 | 0.00 | −2.28 | 0.00 | 0.00 | 0.00 | 0.00 | 0.00 | 4 | HGG 1 |
| 560115 | −1.24 | −2.69 to −0.19 | −1.08 | −1.77 | −0.19 | −0.84 | −2.23 | −0.40 | −1.03 | −2.69 | −0.97 | 5 | HGG 1 |
| 1619292 | −1.14 | −1.33 to −0.89 | −1.15 | −1.12 | −1.19 | −0.89 | −1.02 | −1.20 | −1.02 | −1.30 | −1.33 | 5 | HGG 1 |
| 2769888 | −1.40 | −1.92 to −0.74 | −0.74 | −1.84 | −1.42 | −0.77 | −1.84 | −1.54 | −0.92 | −1.92 | −1.62 | 5 | HGG 1 |
| 1552522 | 0.04 | −1.73 to 0.58 | 0.39 | 0.22 | 0.39 | 0.58 | 0.23 | 0.00 | 0.05 | 0.24 | −1.73 | 0 | HGG 2 |
| 757370 | −0.28 | −2.56 to 0.00 | 0.00 | 0.00 | 0.00 | 0.00 | 0.00 | 0.00 | 0.00 | 0.00 | −2.56 | 0 | HGG 2 |
| 1740788 | −0.19 | −1.67 to 0.25 | 0.17 | −0.18 | 0.03 | 0.25 | −0.13 | 0.02 | −1.67 | −0.18 | −0.03 | 0 | HGG 2 |
| 2314164 | −0.03 | −1.54 to 0.58 | 0.58 | 0.30 | 0.42 | 0.00 | 0.00 | 0.00 | −1.54 | 0.00 | 0.00 | 0 | HGG 2 |
| 1995136 | −0.14 | −1.82 to 0.57 | 0.57 | 0.31 | 0.17 | −1.82 | −0.62 | 0.00 | 0.10 | 0.00 | 0.00 | 0 | HGG 2 |
| 2444137 | −0.10 | −2.63 to 0.32 | 0.32 | 0.24 | 0.15 | 0.31 | 0.14 | 0.21 | 0.20 | 0.13 | −2.63 | 0 | HGG 2 |
| 1735702 | −0.36 | −1.93 to 0.36 | 0.00 | 0.00 | 0.36 | −1.93 | −1.66 | 0.00 | 0.00 | 0.00 | 0.00 | 1 | HGG 2 |
| 3100048 | −1.22 | −2.22 to −0.49 | −0.49 | −2.22 | −1.12 | −0.65 | −1.79 | −1.39 | −0.67 | −1.39 | −1.20 | 1 | HGG 2 |
| 1988774 | −0.57 | −1.47 to 0.02 | −0.12 | −0.86 | −0.15 | 0.02 | −0.97 | −0.19 | −0.61 | −1.47 | −0.82 | 1 | HGG 2 |
| 2607834 | 0.92 | 0.00 to 1.85 | 0.00 | 1.02 | 1.70 | 0.42 | 1.30 | 1.85 | 0.28 | 0.00 | 1.71 | 2 | HGG 2 |
| 3409540 | −0.13 | −1.33 to 0.13 | 0.00 | −1.33 | −0.04 | 0.13 | 0.00 | 0.03 | 0.05 | −0.04 | 0.07 | 0 | HGG 3 |
| 3639747 | −0.14 | −1.52 to 0.23 | 0.00 | −1.52 | 0.23 | 0.00 | 0.00 | 0.00 | 0.00 | 0.00 | 0.00 | 0 | HGG 3 |
| 4247951 | −0.22 | −1.96 to 0.00 | 0.00 | −1.96 | 0.00 | 0.00 | 0.00 | 0.00 | 0.00 | 0.00 | 0.00 | 0 | HGG 3 |
| 5166479 | −0.37 | −2.16 to 0.00 | −1.18 | −2.16 | 0.00 | 0.00 | 0.00 | 0.00 | 0.00 | 0.00 | 0.00 | 0 | HGG 3 |
| 1911443 | −0.96 | −1.56 to −0.22 | −0.22 | −1.10 | −1.10 | −0.49 | −1.06 | −1.56 | −0.53 | −1.11 | −1.46 | 1 | HGG 3 |
| 5427710 | −0.90 | −1.48 to −0.46 | −0.62 | −0.72 | −1.32 | −0.46 | −0.67 | −1.48 | −0.71 | −0.79 | −1.30 | 1 | HGG 3 |
| 3120209 | −1.11 | −1.63 to −0.52 | −1.33 | −1.14 | −0.60 | −1.36 | −1.30 | −0.81 | −1.63 | −1.26 | −0.52 | 1 | HGG 3 |
| 3135460 | −0.73 | −1.43 to −0.26 | −0.46 | −1.31 | −0.63 | −0.37 | −1.43 | −0.65 | −0.26 | −1.07 | −0.40 | 1 | HGG 3 |

TABLE 14-continued

| Clone ID | Ave De t/ Danazol | Range | mean DE t/ Danazol 1 μM, 1 hr | mean DE t/ Danazol 1 μM, 3 hr | mean DE t/ Danazol 1 μM, 6 hr | mean DE t/ Danazol 10 μM, 1 hr | mean DE t/ Danazol 10 μM, 3 hr | mean DE t/ Danazol 10 μM, 6 hr | mean DE t/ Danazol 100 μM, 1 hr | mean DE t/ Danazol 100 μM, 3 hr | mean DE t/ Danazol 100 μM, 6 hr | Cluster | GEM |
|---|---|---|---|---|---|---|---|---|---|---|---|---|---|
| 2047312 | −0.14 | −1.75 to 0.29 | 0.00 | −1.75 | 0.11 | 0.00 | 0.00 | 0.00 | 0.12 | 0.00 | 0.29 | 2 | HGG 3 |
| 5024212 | −0.17 | −2.18 to 0.32 | 0.00 | −2.18 | 0.12 | 0.00 | 0.00 | 0.00 | 0.32 | 0.00 | 0.18 | 2 | HGG 3 |
| 4181663 | −0.04 | −1.61 to 0.28 | 0.00 | −1.61 | 0.21 | 0.22 | 0.01 | 0.25 | 0.18 | 0.07 | 0.28 | 2 | HGG 3 |
| 3481841 | 0.05 | −1.47 to 0.39 | 0.35 | −1.47 | 0.12 | 0.24 | 0.13 | 0.36 | 0.18 | 0.15 | 0.39 | 2 | HGG 3 |
| 2407620 | −0.26 | −2.26 to 0.14 | 0.04 | −0.14 | −0.05 | 0.08 | 0.14 | −2.26 | −0.16 | −0.07 | 0.12 | 0 | HGG 4 |
| 2750849 | −0.15 | −1.39 to 0.11 | 0.11 | −0.11 | 0.02 | −1.39 | 0.00 | 0.00 | 0.00 | 0.00 | 0.00 | 0 | HGG 4 |
| 1495907 | −0.14 | −1.53 to 0.18 | 0.00 | 0.08 | 0.18 | −1.53 | 0.00 | 0.00 | 0.00 | 0.00 | 0.00 | 0 | HGG 4 |
| 3143494 | −0.23 | −2.10 to 0.00 | 0.00 | 0.00 | 0.00 | −2.10 | 0.00 | 0.00 | 0.00 | 0.00 | 0.00 | 0 | HGG 4 |
| 3451296 | −0.15 | −1.38 to 0.00 | 0.00 | 0.00 | 0.00 | 0.00 | 0.00 | 0.00 | −1.38 | 0.00 | 0.00 | 0 | HGG 4 |
| 951433 | −0.14 | −1.37 to 0.07 | 0.00 | 0.05 | 0.07 | −1.37 | 0.00 | 0.00 | 0.00 | 0.00 | 0.00 | 0 | HGG 4 |
| 2322243 | −0.23 | −2.09 to 0.00 | 0.00 | 0.00 | 0.00 | 0.00 | 0.00 | 0.00 | −2.09 | 0.00 | 0.00 | 0 | HGG 4 |
| 4970829 | 0.20 | −0.04 to 1.57 | 0.16 | −0.04 | 0.12 | 1.57 | 0.00 | 0.00 | 0.00 | 0.00 | 0.00 | 1 | HGG 4 |
| 3253462 | 0.25 | 0.00 to 1.54 | 0.39 | 0.07 | 0.26 | 1.54 | 0.00 | 0.00 | 0.00 | 0.00 | 0.00 | 1 | HGG 4 |
| 1834257 | −0.14 | −1.58 to 0.22 | 0.00 | 0.09 | 0.22 | 0.00 | 0.00 | 0.00 | 0.00 | 0.00 | −1.58 | 1 | HGG 4 |
| 2110035 | −0.12 | −1.82 to 0.29 | 0.29 | 0.17 | 0.22 | 0.00 | 0.19 | 0.00 | −0.13 | 0.00 | −1.82 | 1 | HGG 4 |
| 3880722 | −0.55 | −2.28 to 0.24 | −0.02 | −0.49 | −0.62 | 0.24 | −0.52 | −1.09 | −0.15 | 0.00 | −2.28 | 1 | HGG 4 |
| 1357231 | −0.74 | −1.42 to −0.23 | −0.24 | −0.53 | −1.42 | −0.23 | −0.84 | −1.04 | −0.33 | −1.00 | −1.05 | 2 | HGG 4 |
| 1449819 | −0.83 | −1.82 to 0.32 | 0.32 | −1.27 | −0.72 | −0.05 | −1.61 | −0.92 | −0.29 | −1.82 | −1.14 | 2 | HGG 4 |
| 2055569 | −1.37 | −2.10 to −0.74 | −0.74 | −2.10 | −1.34 | −0.80 | −2.07 | −1.47 | −0.78 | −1.45 | −1.56 | 2 | HGG 4 |

TABLE 15

| Clone ID | GenBank ID | Annotation | Ave DE [log2] (C3A treated with steroid) | Steroid |
|---|---|---|---|---|
| 279898 | 187530 | Human metallothionein-II pseudogene (mt- | 1.40 | Mifepristone |
| 279898 | 187530 | Human metallothionein-II pseudogene (mt- | 1.52 | progesterone |
| 279898 | 187530 | Human metallothionein-II pseudogene (mt- | 1.06 | beclomethasone |
| 279898 | 187530 | Human metallothionein-II pseudogene (mt- | 1.43 | MAH |
| 279898 | 187530 | Human metallothionein-II pseudogene (mt- | 1.30 | budesonide |
| 279898 | 187530 | Human metallothionein-II pseudogene (mt- | 0.97 | prednisone |
| 279898 | 187530 | Human metallothionein-II pseudogene (mt- | 0.87 | dexamethasone |
| 279898 | 187530 | Human metallothionein-II pseudogene (mt- | 1.30 | betamethasone |
| 279898 | 187530 | Human metallothionein-II pseudogene (mt- | 1.83 | danazol |
| 560115 | 1778716 | Human chemokine exodus-1 mRNA, | −1.45 | Mifepristone |
| 560115 | 1778716 | Human chemokine exodus-1 mRNA, | −2.08 | progesterone |
| 560115 | 1778716 | Human chemokine exodus-1 mRNA, | −1.89 | beclomethasone |
| 560115 | 1778716 | Human chemokine exodus-1 mRNA, | −2.07 | MAH |
| 560115 | 1778716 | Human chemokine exodus-1 mRNA, | −2.04 | budesonide |
| 560115 | 1778716 | Human chemokine exodus-1 mRNA, | −1.93 | prednisone |
| 560115 | 1778716 | Human chemokine exodus-1 mRNA, | −2.00 | dexamethasone |
| 560115 | 1778716 | Human chemokine exodus-1 mRNA, | −1.87 | betamethasone |
| 560115 | 1778716 | Human chemokine exodus-1 mRNA, | −1.24 | danazol |
| 1619292 | 30302 | Human mRNA for cytochrome cl. | −0.93 | Mifepristone |
| 1619292 | 30302 | Human mRNA for cytochrome cl. | −1.28 | progesterone |
| 1619292 | 30302 | Human mRNA for cytochrome cl. | −1.57 | beclomethasone |
| 1619292 | 30302 | Human mRNA for cytochrome cl. | −1.52 | MAH |
| 1619292 | 30302 | Human mRNA for cytochrome cl. | −1.38 | budesonide |
| 1619292 | 30302 | Human mRNA for cytochrome cl. | −1.50 | prednisone |
| 1619292 | 30302 | Human mRNA for cytochrome cl. | −1.67 | dexamethasone |
| 1619292 | 30302 | Human mRNA for cytochrome cl. | −1.45 | betamethasone |
| 1619292 | 30302 | Human mRNA for cytochrome cl. | −1.14 | danazol |
| 2769888 | 587201 | Human HK2 mRNA for hexokinase II. | −1.29 | Mifepristone |
| 2769888 | 587201 | Humon HK2 mRNA for hexokinase II. | −1.11 | progesterone |
| 2769888 | 587201 | Human HK2 mRNA for hexokinase II. | −1.15 | beclomethasone |
| 2769888 | 587201 | Human HK2 mRNA for hexokinase II. | −1.22 | MAH |
| 2769888 | 587201 | Human HK2 mRNA for hexokinase II. | −0.95 | budesonide |
| 2769888 | 587201 | Human HK2 mRNA for hexokinase II. | −1.07 | prednisone |
| 2769888 | 587201 | Human HK2 mRNA for hexokinase II. | −1.21 | dexamethasone |
| 2769888 | 587201 | Human HK2 mRNA for hexokinase II. | −1.03 | betamethasone |
| 2769888 | 587201 | Human HK2 mRNA for hexokinase II. | −1.40 | danazol |
| 3120209 | g7020644 | Human cDNA FLJ20500 fis, clone KAT09159. | −1.24 | Mifepristone |
| 3120209 | g7020644 | Human cDNA FLJ20500 fis, clone KAT09159. | −1.43 | progesterone |
| 3120209 | g7020644 | Human cDNA FLJ20500 fis, clone KAT09159. | −1.53 | beclomethasone |
| 3120209 | g7020644 | Human cDNA FLJ20500 fis, clone KAT09159. | −1.51 | MAH |
| 3120209 | g7020644 | Human cDNA FLJ20500 fis, clone KAT09159. | −1.45 | budesonide |
| 3120209 | g7020644 | Human cDNA FLJ20500 fis, clone KAT09159. | −1.75 | prednisone |
| 3120209 | g7020644 | Human cDNA FLJ20500 fis, clone KAT09159. | −1.91 | dexamethasone |

TABLE 15-continued

| Clone ID | GenBank ID | Annotation | Ave DE [log2] (C3A treated with steroid) | Steroid |
|---|---|---|---|---|
| 3120209 | g7020644 | Human cDNA FLJ20500 fis, clone KAT09159. | −0.99 | betamethasone |
| 3120209 | g7020644 | Human cDNA FLJ20500 fis, clone KAT09159. | −1.11 | danazol |
| 3135460 | g6708478 | formin-like protein | −1.04 | Mifepristone |
| 3135460 | g6708478 | formin-like protein | −1.02 | progesterone |
| 3135460 | g6708478 | formin-like protein | −1.22 | beclomethasone |
| 3135460 | g6708478 | formin-like protein | −1.37 | MAH |
| 3135460 | g6708478 | formin-like protein | −1.36 | budesonide |
| 3135460 | g6708478 | formin-like protein | −1.33 | prednisone |
| 3135460 | g6708478 | formin-like protein | −1.11 | dexamethasone |
| 3135460 | g6708478 | formin-like protein | −1.04 | betamethasone |
| 3135460 | g6708478 | formin-like protein | −0.73 | danazol |
| 4287327 | 452443 | Human glucose-6-phosphatase mRNA, complete cds. | 1.26 | Mifepristone |
| 4287327 | 452443 | Human glucose-6-phosphatase mRNA, complete cds. | 2.26 | progesterone |
| 4287327 | 452443 | Human glucose-6-phosphatase mRNA, complete cds. | 2.43 | beclomethasone |
| 4287327 | 452443 | Human glucose-6-phosphatase mRNA, complete cds. | 2.29 | MAH |
| 4287327 | 452443 | Human glucose-6-phosphatase mRNA, complete cds. | 2.49 | budesonide |
| 4287327 | 452443 | Human glucose-6-phosphatase mRNA, complete cds. | 2.18 | prednisone |
| 4287327 | 452443 | Human glucose-6-phosphatase mRNA, complete cds. | 2.15 | dexamethasone |
| 4287327 | 452443 | Human glucose-6-phosphatase mRNA, complete cds. | 2.30 | betamethasone |
| 4287327 | 452443 | Human glucose-6-phosphatase mRNA, complete cds. {Incvte:A287327} | 1.27 | danazol |
| 4408943 | 5732679 | Human amino acid transporter B0+ (ATB0+) mRNA, complete cds. | −0.96 | Mifepristone |
| 4408943 | 5732679 | Human amino acid transporter B0+ (ATB0+) mRNA, complete cds. | −1.85 | progesterone |
| 4408943 | 5732679 | Human amino acid transporter B0+ (ATB0+) mRNA, complete cds. | −1.55 | beclomethasone |
| 4408943 | 5732679 | Human amino acid transporter B0+ (ATB0+) mRNA, complete cds. | −1.93 | MAH |
| 4408943 | 5732679 | Human amino acid transporter B0+ (ATB0+) mRNA, complete cds. | −1.76 | budesonide |
| 4408943 | 5732679 | Human amino acid transporter B0+ (ATB0+) mRNA, complete cds. | −1.54 | prednisone |
| 4408943 | 5732679 | Human amino acid transporter B0+ (ATB0+) mRNA, complete cds. | −1.68 | dexamethasone |
| 4408943 | 5732679 | Human amino acid transporter B0+ (ATB0+) mRNA, complete cds. | −1.52 | betamethasone |
| 4408943 | 5732679 | Human amino acid transporter B0+ (ATB0+) mRNA, complete cds. | −0.92 | danazol |
| 5047895 | 6049603 | Human dickkopf-1 (DKK-1) mRNA, complete | −1.19 | Mifepristone |
| 5047895 | 6049603 | Human dickkopf-1 (DKK-1) mRNA, complete | −1.62 | progesterone |
| 5547895 | 6049603 | Human dickkopf-1 (DKK-1) mRNA, complete | −1.65 | beclomethasone |
| 5047895 | 6049603 | Human dickkopf-1 (DKK-1) mRNA, complete | −1.71 | MAH |
| 5047895 | 6049603 | Human dickkopf-1 (DKK-1) mRNA, complete | −1.67 | budesonide |
| 5047895 | 6049603 | Human dickkopf-1 (DKK-1) mRNA, complete | −1.44 | prednisone |
| 5047895 | 6049603 | Human dickkopf-1 (DKK-1) mRNA, complete | −1.79 | dexamethasone |
| 5047895 | 6049603 | Human dickkopf-1 (DKK-1) mRNA, complete | −1.35 | betamethasone |
| 5047895 | 6049603 | Human dickkopf-1 (DKK-1) mRNA, complete | −0.95 | danazol |
| 5166479 | 1806039 | Human mRNA for adipophilin. | −1.28 | Mifepristone |
| 5166479 | 1806039 | Human mRNA for adipophilin. | −1.50 | progesterone |
| 5166479 | 1806039 | Human mRNA for adipophilin. | −1.42 | beclomethasone |
| 5166479 | 1806039 | Human mRNA for adipophilin. | −1.47 | MAH |
| 5166479 | 1806039 | Human mRNA for adipophilin. | −1.43 | budesonide |
| 5166479 | 1806039 | Human mRNA for adipophilin. | −1.56 | prednisone |
| 5166479 | 1806039 | Human mRNA for adipophilin. | −1.58 | dexamethasone |
| 5166479 | 1806039 | Human mRNA for adipophilin. | −1.36 | betamethasone |
| 5166479 | 1806039 | Human mRNA for adipophilin. | −0.37 | danazol |
| 5427710 | g7293114 | CG8198 gene product | −0.94 | Mifepristone |
| 5427710 | g7293114 | CG8198 gene product | −1.76 | progesterone |
| 5427710 | g7293114 | CG8198 gene product | −1.99 | beclomethasone |
| 5427710 | g7293114 | CG8198 gene product | −2.13 | MAH |
| 5427710 | g7293114 | CG8198 gene product | −1.96 | budesonide |
| 5427710 | g7293114 | CG8198 gene product | −2.08 | prednisone |
| 5427710 | g7293114 | CG8198 gene product | −1.99 | dexamethasone |
| 5427710 | g7293114 | CG8198 gene product | −1.82 | betamethasone |
| 5427710 | g7293114 | CG8198 gene product | −0.90 | danazol |

TABLE 16

| Clone ID | Ave DE [log2] (C3A treated with steroid) | Steroid |
|---|---|---|
| 435610 | 0.80 | beclomethasone |
| 597555 | 0.96 | beclomethasone |
| 1236305 | 0.89 | beclomethasone |
| 1425150 | 1.03 | beclomethasone |
| 1547122 | 0.21 | beclomethasone |
| 1636015 | 0.51 | beclomethasone |
| 2110103 | 0.36 | beclomethasone |
| 2252501 | 0.28 | beclomethasone |
| 2364257 | 0.37 | beclomethasone |
| 2370756 | 0.58 | beclomethasone |
| 2447829 | −0.67 | beclomethasone |
| 2667438 | 0.86 | beclomethasone |
| 2724032 | 0.68 | beclomethasone |
| 2797740 | 0.32 | beclomethasone |
| 2836470 | −0.18 | beclomethasone |
| 2874010 | −0.59 | beclomethasone |
| 2908777 | −0.32 | beclomethasone |
| 3123530 | 0.77 | beclomethasone |
| 3915205 | 1.23 | beclomethasone |
| 4070403 | −1.00 | beclomethasone |
| 4091186 | 0.94 | beclomethasone |
| 4222957 | 0.26 | beclomethasone |
| 4223734 | −0.38 | beclomethasone |
| 4297813 | −1.09 | beclomethasone |
| 4298848 | −0.19 | beclomethasone |
| 4312603 | −0.30 | beclomethasone |
| 5275693 | 1.00 | beclomethasone |
| 13504 | 0.40 | betamethasone |
| 89691 | 0.49 | betamethasone |
| 126877 | 0.50 | betamethasone |
| 128891 | 0.48 | betamethasone |
| 172023 | 0.87 | betamethasone |
| 195943 | 0.48 | betamethasone |
| 262712 | 0.43 | betamethasone |
| 275757 | 0.35 | betamethasone |
| 278939 | 0.39 | betamethasone |
| 309006 | 0.78 | betamethasone |
| 339737 | 0.51 | betamethasone |
| 428897 | 0.71 | betamethasone |
| 451090 | 0.49 | betamethasone |
| 538427 | 0.69 | betamethasone |
| 566093 | 0.27 | betamethasone |
| 592085 | 0.95 | betamethasone |
| 819036 | 0.51 | betamethasone |
| 830408 | 1.04 | betamethasone |
| 854872 | 0.44 | betamethasone |
| 964939 | 0.53 | betamethasone |
| 1001486 | 0.87 | betamethasone |
| 1214989 | 0.54 | betamethasone |
| 1266985 | 0.74 | betamethasone |
| 1306222 | 0.16 | betamethasone |
| 1316801 | 1.97 | betamethasone |
| 1364694 | 0.52 | betamethasone |
| 1415119 | 0.37 | betamethasone |
| 1469028 | 1.16 | betamethasone |
| 1495730 | 0.47 | betamethasone |
| 1496066 | 0.68 | betamethasone |
| 1503162 | 0.61 | betamethasone |
| 1569904 | 0.75 | betamethasone |
| 1571861 | 0.23 | betamethasone |
| 1578941 | 0.43 | betamethasone |
| 1635877 | 0.78 | betamethasone |
| 1637145 | 0.94 | betamethasone |
| 1661892 | 1.61 | betamethasone |
| 1697855 | 0.85 | betamethasone |
| 1820105 | 0.28 | betamethasone |
| 1831454 | 0.63 | betamethasone |
| 1833010 | 0.25 | betamethasone |
| 1852354 | 0.85 | betamethasone |
| 1960822 | 0.75 | betamethasone |
| 1979363 | 0.85 | betamethasone |
| 1981569 | 0.58 | betamethasone |
| 2005266 | 0.28 | betamethasone |
| 2008331 | 0.50 | betamethasone |
| 2132784 | 0.53 | betamethasone |
| 2189237 | 0.37 | betamethasone |
| 2252906 | 0.94 | betamethasone |
| 2271648 | 0.33 | betamethasone |
| 2273619 | 0.36 | betamethasone |
| 2276895 | 0.66 | betamethasone |
| 2497692 | 0.93 | betamethasone |
| 2631261 | 0.97 | betamethasone |
| 2669337 | −0.70 | betamethasone |
| 2753963 | 0.34 | betamethasone |
| 2823478 | 1.11 | betamethasone |
| 2874881 | 0.64 | betamethasone |
| 2881039 | 0.50 | betamethasone |
| 2915217 | 0.84 | betamethasone |
| 2933127 | 0.49 | betamethasone |
| 2933175 | 1.05 | betamethasone |
| 2948678 | 0.26 | betamethasone |
| 3045419 | 1.14 | betamethasone |
| 3187861 | 0.36 | betamethasone |
| 3369213 | 0.29 | betamethasone |
| 3410101 | 0.31 | betamethasone |
| 3434166 | 0.65 | betamethasone |
| 3479268 | 0.43 | betamethasone |
| 3508345 | 0.46 | betamethasone |
| 3571607 | 0.85 | betamethasone |
| 3607580 | 0.51 | betamethasone |
| 3659618 | 0.18 | betamethasone |
| 3686411 | 0.41 | betamethasone |
| 3967255 | 0.23 | betamethasone |
| 4000614 | 0.50 | betamethasone |
| 4112181 | 0.97 | betamethasone |
| 4195203 | 0.81 | betamethasone |
| 4228236 | 0.87 | betamethasone |
| 4312860 | 1.14 | betamethasone |
| 4373333 | 1.12 | betamethasone |
| 4606503 | 0.50 | betamethasone |
| 4695453 | 0.77 | betamethasone |
| 4738532 | 1.37 | betamethasone |
| 5094042 | 0.98 | betamethasone |
| 5186846 | 0.11 | betamethasone |
| 5285915 | 0.66 | betamethasone |
| 5372104 | 0.34 | betamethasone |
| 278100 | 0.21 | budesonide |
| 380041 | −0.37 | budesonide |
| 408442 | 0.35 | budesonide |
| 523797 | −1.05 | budesonide |
| 621216 | 0.79 | budesonide |
| 835756 | 0.94 | budesonide |
| 868678 | 0.39 | budesonide |
| 1211357 | 0.19 | budesonide |
| 1305249 | −0.98 | budesonide |
| 1317428 | 0.19 | budesonide |
| 1446475 | −0.70 | budesonide |
| 1447306 | 0.41 | budesonide |
| 1495947 | 0.46 | budesonide |
| 1597837 | 0.46 | budesonide |
| 1604650 | −0.70 | budesonide |
| 1662632 | −0.62 | budesonide |
| 1707037 | −0.23 | budesonide |
| 1721320 | −0.97 | budesonide |
| 1737512 | 0.24 | budesonide |
| 1799078 | −0.70 | budesonide |
| 1868738 | −0.82 | budesonide |
| 1900173 | 0.78 | budesonide |
| 1942785 | 0.85 | budesonide |
| 2057265 | 1.06 | budesonide |
| 2131956 | −0.99 | budesonide |
| 2156661 | 0.91 | budesonide |
| 2169433 | 0.29 | budesonide |
| 2215282 | 0.55 | budesonide |
| 2239738 | −0.20 | budesonide |
| 2293494 | −0.69 | budesonide |
| 2346851 | −0.97 | budesonide |
| 2347684 | −0.30 | budesonide |
| 2399169 | 0.21 | budesonide |
| 2399665 | −0.70 | budesonide |

TABLE 16-continued

| Clone ID | Ave DE [log2] (C3A treated with steroid) | Steroid |
|---|---|---|
| 2529162 | −0.96 | budesonide |
| 2539933 | −0.16 | budesonide |
| 2579218 | 0.85 | budesonide |
| 2611889 | 0.15 | budesonide |
| 2702786 | 0.19 | budesonide |
| 2706669 | −0.87 | budesonide |
| 2726759 | −0.02 | budesonide |
| 2747179 | −0.99 | budesonide |
| 2760615 | 0.23 | budesonide |
| 2803833 | 0.42 | budesonide |
| 3029474 | −0.99 | budesonide |
| 3091135 | 0.01 | budesonide |
| 3188660 | 0.61 | budesonide |
| 3332232 | 1.08 | budesonide |
| 3979665 | −0.04 | budesonide |
| 4003460 | −0.71 | budesonide |
| 4203937 | 0.76 | budesonide |
| 4248767 | −0.51 | budesonide |
| 4251117 | 0.98 | budesonide |
| 4284384 | 1.13 | budesonide |
| 5044351 | −0.88 | budesonide |
| 5280239 | −1.02 | budesonide |
| 5424122 | −0.87 | budesonide |
| 5507406 | 0.95 | budesonide |
| 5867032 | 0.19 | budesonide |
| 120110 | −0.62 | danazol |
| 322933 | −0.29 | danazol |
| 389558 | −0.37 | danazol |
| 746910 | −0.19 | danazol |
| 757370 | −0.28 | danazol |
| 932244 | −0.31 | danazol |
| 951433 | −0.14 | danazol |
| 960496 | −0.34 | danazol |
| 997480 | −0.24 | danazol |
| 1219506 | −0.36 | danazol |
| 1269921 | −0.39 | danazol |
| 1274378 | −0.25 | danazol |
| 1310337 | −0.20 | danazol |
| 1328741 | −0.39 | danazol |
| 1350683 | −0.16 | danazol |
| 1357231 | −0.74 | danazol |
| 1405844 | 0.49 | danazol |
| 1495907 | −0.14 | danazol |
| 1506930 | −0.25 | danazol |
| 1518310 | −0.47 | danazol |
| 1552522 | 0.04 | danazol |
| 1638756 | −0.18 | danazol |
| 1715374 | −0.78 | danazol |
| 1735702 | −0.36 | danazol |
| 1740788 | −0.19 | danazol |
| 1802939 | −0.33 | danazol |
| 1804503 | −0.44 | danazol |
| 1834257 | −0.14 | danazol |
| 1853116 | −0.55 | danazol |
| 1904987 | −0.35 | danazol |
| 1995136 | −0.14 | danazol |
| 2047312 | −0.14 | danazol |
| 2110035 | −0.12 | danazol |
| 2158674 | −0.42 | danazol |
| 2174951 | −0.16 | danazol |
| 2203570 | −0.29 | danazol |
| 2216323 | −0.42 | danazol |
| 2314164 | −0.03 | danazol |
| 2322243 | −0.23 | danazol |
| 2327230 | −0.37 | danazol |
| 2444137 | −0.10 | danazol |
| 2444740 | −0.24 | danazol |
| 2500872 | −0.23 | danazol |
| 2750849 | −0.15 | danazol |
| 2794808 | −0.53 | danazol |
| 2927479 | −0.34 | danazol |
| 2956670 | −0.35 | danazol |
| 3143494 | −0.23 | danazol |
| 3253462 | 0.25 | danazol |
| 3278632 | −0.16 | danazol |
| 3409540 | −0.13 | danazol |
| 3451296 | −0.15 | danazol |
| 3481841 | 0.05 | danazol |
| 3639747 | −0.14 | danazol |
| 3724351 | −0.14 | danazol |
| 3880722 | −0.55 | danazol |
| 4181663 | −0.04 | danazol |
| 4247951 | −0.22 | danazol |
| 4292488 | −0.35 | danazol |
| 4587665 | −0.20 | danazol |
| 4741591 | −0.41 | danazol |
| 4759669 | −0.27 | danazol |
| 4896168 | 0.44 | danazol |
| 4970829 | 0.20 | danazol |
| 5024212 | −0.17 | danazol |
| 5033671 | 0.48 | danazol |
| 5207486 | −0.24 | danazol |
| 5326338 | −0.34 | danazol |
| 5405691 | −0.26 | danazol |
| 41247 | −0.34 | dexamethasone |
| 198719 | −1.19 | dexamethasone |
| 223436 | −0.97 | dexamethasone |
| 293477 | −1.35 | dexamethasone |
| 496946 | −1.08 | dexamethasone |
| 509758 | −1.16 | dexamethasone |
| 526319 | −0.49 | dexamethasone |
| 562585 | −1.21 | dexamethasone |
| 608725 | −1.04 | dexamethasone |
| 620879 | 0.31 | dexamethasone |
| 630375 | −0.19 | dexamethasone |
| 641510 | −0.26 | dexamethasone |
| 678955 | −1.02 | dexamethasone |
| 777716 | −0.20 | dexamethasone |
| 1235535 | −1.12 | dexamethasone |
| 1306062 | 0.18 | dexamethasone |
| 1319021 | −1.14 | dexamethasone |
| 1331853 | −1.16 | dexamethasone |
| 1366040 | 0.15 | dexamethasone |
| 1377668 | −0.81 | dexamethasone |
| 1416978 | −1.04 | dexamethasone |
| 1437552 | −1.15 | dexamethasone |
| 1478855 | −0.19 | dexamethasone |
| 1501809 | 0.33 | dexamethasone |
| 1511262 | −1.28 | dexamethasone |
| 1520151 | −0.83 | dexamethasone |
| 1594179 | −0.93 | dexamethasone |
| 1636594 | 0.25 | dexamethasone |
| 1667220 | −0.97 | dexamethasone |
| 1696552 | 0.41 | dexamethasone |
| 1700074 | 0.45 | dexamethasone |
| 1706751 | −1.10 | dexamethasone |
| 1728013 | −1.11 | dexamethasone |
| 1732792 | −0.91 | dexamethasone |
| 1805836 | −1.02 | dexamethasone |
| 1822143 | 0.28 | dexamethasone |
| 1848722 | −1.21 | dexamethasone |
| 1886928 | −0.60 | dexamethasone |
| 1979756 | −1.06 | dexamethasone |
| 1988593 | −1.07 | dexamethasone |
| 2009252 | 0.20 | dexamethasone |
| 2044184 | 0.14 | dexamethasone |
| 2051966 | −1.04 | dexamethasone |
| 2060823 | −1.09 | dexamethasone |
| 2089176 | −1.10 | dexamethasone |
| 2095144 | −1.24 | dexamethasone |
| 2095268 | −1.00 | dexamethasone |
| 2095728 | −1.01 | dexamethasone |
| 2239236 | −0.74 | dexamethasone |
| 2268923 | −1.18 | dexamethasone |
| 2273944 | −0.45 | dexamethasone |
| 2284694 | −1.07 | dexamethasone |
| 2286360 | −1.26 | dexamethasone |
| 2287426 | −1.16 | dexamethasone |
| 2345426 | −1.08 | dexamethasone |
| 2394616 | −0.95 | dexamethasone |

TABLE 16-continued

| Clone ID | Ave DE [log2] (C3A treated with steroid) | Steroid |
|---|---|---|
| 2420388 | −0.17 | dexamethasone |
| 2458526 | −0.89 | dexamethasone |
| 2504870 | 1.02 | dexamethasone |
| 2571644 | 0.28 | dexamethasone |
| 2705256 | −0.20 | dexamethasone |
| 2822027 | 0.82 | dexamethasone |
| 2850323 | −0.76 | dexamethasone |
| 2863211 | −1.17 | dexamethasone |
| 2908546 | 0.18 | dexamethasone |
| 2914439 | −1.11 | dexamethasone |
| 2925373 | −1.10 | dexamethasone |
| 2946292 | −0.87 | dexamethasone |
| 2954059 | −1.22 | dexamethasone |
| 3003980 | 0.22 | dexamethasone |
| 3086833 | −1.06 | dexamethasone |
| 3398189 | −1.11 | dexamethasone |
| 3144511 | 0.26 | dexamethasone |
| 3187903 | 0.22 | dexamethasone |
| 3284411 | −1.16 | dexamethasone |
| 3381870 | 0.88 | dexamethasone |
| 3408939 | 0.17 | dexamethasone |
| 3566941 | 0.24 | dexamethasone |
| 3614283 | 0.46 | dexamethasone |
| 3736815 | 0.26 | dexamethasone |
| 3747901 | −0.99 | dexamethasone |
| 3818422 | 0.91 | dexamethasone |
| 3926757 | 0.48 | dexamethasone |
| 3983862 | −0.98 | dexamethasone |
| 4003219 | 0.19 | dexamethasone |
| 4221092 | 0.18 | dexamethasone |
| 4249090 | 0.17 | dexamethasone |
| 4252768 | 0.17 | dexamethasone |
| 4288091 | −0.06 | dexamethasone |
| 4291619 | 0.17 | dexamethasone |
| 4307290 | 0.17 | dexamethasone |
| 4334474 | −1.07 | dexamethasone |
| 4339883 | −0.21 | dexamethasone |
| 4464538 | −1.05 | dexamethasone |
| 4505265 | 0.18 | dexamethasone |
| 4611240 | 0.17 | dexamethasone |
| 4717363 | 0.18 | dexamethasone |
| 4792726 | −0.70 | dexamethasone |
| 4860060 | −1.29 | dexamethasone |
| 4872725 | 0.18 | dexamethasone |
| 4883207 | 0.17 | dexamethasone |
| 5038604 | 0.19 | dexamethasone |
| 5106915 | 0.19 | dexamethasone |
| 5115293 | 0.18 | dexamethasone |
| 5138591 | 0.19 | dexamethasone |
| 5198045 | −0.95 | dexamethasone |
| 5262558 | 0.20 | dexamethasone |
| 5281739 | −0.85 | dexamethasone |
| 5291215 | 0.17 | dexamethasone |
| 5321996 | 0.47 | dexamethasone |
| 5323022 | 0.17 | dexamethasone |
| 5374705 | 0.33 | dexamethasone |
| 5506170 | −0.74 | dexamethasone |
| 96752 | −1.08 | MAH |
| 129775 | 0.97 | MAH |
| 269310 | −0.89 | MAH |
| 301206 | 0.67 | MAH |
| 346017 | 0.78 | MAH |
| 435549 | 0.81 | MAH |
| 489820 | −0.27 | MAH |
| 569348 | 0.42 | MAH |
| 641039 | 0.29 | MAH |
| 646463 | 0.37 | MAH |
| 693783 | −0.87 | MAH |
| 761282 | 1.04 | MAH |
| 859218 | 0.96 | MAH |
| 893224 | 1.05 | MAH |
| 898741 | 0.47 | MAH |
| 916103 | 0.26 | MAH |
| 1209413 | −0.15 | MAH |
| 1284155 | −1.10 | MAH |
| 1482166 | 0.23 | MAH |
| 1645304 | 0.53 | MAH |
| 1700287 | −1.11 | MAH |
| 1740975 | −0.04 | MAH |
| 1741288 | 0.12 | MAH |
| 1888260 | 1.18 | MAH |
| 1909281 | 0.18 | MAH |
| 1927771 | 0.52 | MAH |
| 1930088 | −0.16 | MAH |
| 1995767 | 1.00 | MAH |
| 1998317 | −0.15 | MAH |
| 2051568 | 0.50 | MAH |
| 2176212 | −0.74 | MAH |
| 2188005 | −0.83 | MAH |
| 2260285 | −0.18 | MAH |
| 2268803 | 0.40 | MAH |
| 2291665 | −0.17 | MAH |
| 2302785 | −0.19 | MAH |
| 2302810 | 0.34 | MAH |
| 2313581 | −0.20 | MAH |
| 2383242 | −0.15 | MAH |
| 2395112 | 0.20 | MAH |
| 2428314 | 1.01 | MAH |
| 2499418 | 0.84 | MAH |
| 2507552 | −1.06 | MAH |
| 2619954 | −1.05 | MAH |
| 2663164 | −0.86 | MAH |
| 2675433 | 0.59 | MAH |
| 2707635 | 0.66 | MAH |
| 2742315 | 0.30 | MAH |
| 2756747 | 1.00 | MAH |
| 2761527 | 0.35 | MAH |
| 2780013 | −1.09 | MAH |
| 2806983 | −0.88 | MAH |
| 2811404 | −0.92 | MAH |
| 2831351 | −0.87 | MAH |
| 2838627 | 1.08 | MAH |
| 2864790 | −1.00 | MAH |
| 2880819 | −1.08 | MAH |
| 2891601 | 1.04 | MAH |
| 2927486 | −0.90 | MAH |
| 2930673 | −1.09 | MAH |
| 2956869 | 0.91 | MAH |
| 2959255 | 0.21 | MAH |
| 3035780 | −0.30 | MAH |
| 3045790 | −0.77 | MAH |
| 3057267 | 0.67 | MAH |
| 3068429 | −0.86 | MAH |
| 3141607 | −1.00 | MAH |
| 3170010 | −0.46 | MAH |
| 3200811 | −0.77 | MAH |
| 3230318 | −0.88 | MAH |
| 3253978 | 0.36 | MAH |
| 3254430 | −0.77 | MAH |
| 3334476 | −0.99 | MAH |
| 3411051 | −0.14 | MAH |
| 3566383 | 1.09 | MAH |
| 3569151 | 0.16 | MAH |
| 3616233 | −0.86 | MAH |
| 3621521 | 0.42 | MAH |
| 3633707 | 0.73 | MAH |
| 3732960 | 0.62 | MAH |
| 3875135 | −0.82 | MAH |
| 3890145 | −1.09 | MAH |
| 4089755 | 1.19 | MAH |
| 4340307 | 0.63 | MAH |
| 4413637 | −0.91 | MAH |
| 4423361 | −0.90 | MAH |
| 4535971 | −1.00 | MAH |
| 4590473 | −0.96 | MAH |
| 4886605 | −1.13 | MAH |
| 5004556 | −0.93 | MAH |
| 5076842 | −0.62 | MAH |
| 5275515 | −0.17 | MAH |
| 739461 | −0.22 | Mifepristone |

TABLE 16-continued

| Clone ID | Ave DE [log2] (C3A treated with steroid) | Steroid |
|---|---|---|
| 865145 | −0.23 | Mifepristone |
| 1315663 | −0.75 | Mifepristone |
| 1607203 | −0.78 | Mifepristone |
| 1611445 | −0.93 | Mifepristone |
| 1651008 | −0.71 | Mifepristone |
| 2026270 | −0.67 | Mifepristone |
| 2430750 | 0.60 | Mifepristone |
| 2515666 | 1.29 | Mifepristone |
| 4721130 | 0.85 | Mifepristone |
| 168848 | −0.24 | prednisone |
| 198959 | 0.18 | prednisone |
| 626254 | 0.35 | prednisone |
| 1235345 | 0.20 | prednisone |
| 1418276 | 0.24 | prednisone |
| 1507302 | 0.67 | prednisone |
| 1570534 | 1.01 | prednisone |
| 1872858 | 0.24 | prednisone |
| 1899766 | 0.91 | prednisone |
| 1905006 | 0.85 | prednisone |
| 2018808 | 0.21 | prednisone |
| 2019910 | 0.19 | prednisone |
| 2381040 | −0.18 | prednisone |
| 2415118 | 0.22 | prednisone |
| 2753371 | 0.52 | prednisone |
| 2759015 | 0.73 | prednisone |
| 2769732 | 0.33 | prednisone |
| 2817244 | 0.20 | prednisone |
| 2836703 | 0.65 | prednisone |
| 3031872 | 0.15 | prednisone |
| 3049285 | −0.37 | prednisone |
| 3466829 | 0.44 | prednisone |
| 3478570 | 0.49 | prednisone |
| 3629043 | 0.73 | prednisone |
| 3999352 | 0.71 | prednisone |
| 4208369 | 0.12 | prednisone |
| 4223315 | 0.19 | prednisone |
| 4266051 | −0.90 | prednisone |
| 5109437 | 0.01 | prednisone |
| 5325802 | 0.27 | prednisone |
| 5700537 | −0.16 | prednisone |
| 5859590 | −0.23 | prednisone |
| 21957 | 0.47 | progesterone |
| 481402 | 0.06 | progesterone |
| 531842 | −0.26 | progesterone |
| 955538 | 0.28 | progesterone |
| 1337924 | 0.79 | progesterone |
| 1820882 | 0.26 | progesterone |
| 1841901 | 0.95 | progesterone |
| 1981929 | 0.24 | progesterone |
| 2013955 | 0.22 | progesterone |
| 2159706 | 0.23 | progesterone |
| 2233219 | −0.31 | progesterone |
| 2277161 | 0.42 | progesterone |
| 2325802 | 0.76 | progesterone |
| 2427327 | 0.68 | progesterone |
| 2532033 | 0.25 | progesterone |
| 2579572 | 0.20 | progesterone |
| 2756910 | −0.21 | progesterone |
| 2828647 | −0.14 | progesterone |
| 2847188 | 0.26 | progesterone |
| 2847867 | −0.10 | progesterone |
| 2918279 | −0.21 | progesterone |
| 3001817 | −0.17 | progesterone |
| 3098342 | −0.12 | progesterone |
| 3136307 | −0.28 | progesterone |
| 3188631 | −0.17 | progesterone |
| 3188967 | 0.04 | progesterone |
| 3196654 | 0.07 | progesterone |
| 3221109 | 0.29 | progesterone |
| 3253556 | −0.03 | progesterone |
| 3255873 | 0.03 | progesterone |
| 3390535 | 0.30 | progesterone |
| 3714088 | −0.20 | progesterone |
| 3980695 | 0.59 | progesterone |
| 4002388 | 0.04 | progesterone |

TABLE 16-continued

| Clone ID | Ave DE [log2] (C3A treated with steroid) | Steroid |
|---|---|---|
| 4631069 | 0.37 | progesterone |
| 4822285 | 0.32 | progesterone |

TABLE 17

| Clone ID | Ave DE [log2] (C3A treated with steroid) | Steroid |
|---|---|---|
| 167081 | −1.12 | progesterone |
| 167081 | −1.00 | MAH |
| 167081 | −1.10 | dexamethasone |
| 1679683 | 0.25 | progesterone |
| 1683583 | 0.59 | MAH |
| 1986919 | 0.65 | progesterone |
| 1986919 | 0.84 | MAH |
| 2266959 | 0.96 | progesterone |
| 2266959 | 0.29 | MAH |
| 2499905 | 1.24 | progesterone |
| 2499905 | 1.11 | MAH |
| 3220149 | 0.53 | progesterone |
| 3220149 | 0.31 | MAH |
| 3408804 | −1.16 | progesterone |
| 3408804 | −1.49 | MAH |
| 3408804 | −1.24 | budesonide |
| 5045593 | −1.02 | progesterone |
| 5045593 | −1.03 | MAH |
| 1323327 | 0.83 | progesterone |
| 1323327 | 1.00 | betamethasone |
| 1600180 | 1.06 | progesterone |
| 1600180 | 0.77 | betamethasone |
| 1816768 | 0.28 | progesterone |
| 1816768 | 0.24 | betamethasone |
| 2753065 | 0.78 | progesterone |
| 2753065 | 0.75 | betamethasone |
| 3528232 | 0.99 | progesterone |
| 3528232 | 0.38 | beclomethasone |
| 3528232 | 0.80 | betamethasone |
| 3876612 | 0.26 | progesterone |
| 3876612 | 0.19 | betamethasone |
| 2655279 | −1.03 | progesterone |
| 2655279 | −1.21 | dexamethasone |

TABLE 18

| Clone ID | Ave DE [log2] (C3A treated with steroid) | Steroid |
|---|---|---|
| 1398105 | −0.76 | Mifepristone |
| 1398105 | −0.68 | MAH |
| 1781411 | −0.98 | Mifepristone |
| 1781411 | −0.74 | danazol |
| 2890141 | −0.71 | Mifepristone |
| 2890141 | −0.95 | MAH |
| 2890141 | −0.70 | danazol |
| 3715059 | −0.75 | Mifepristone |
| 3715059 | −0.66 | MAH |
| 3715059 | −0.77 | danazol |
| 4110976 | −0.17 | Mifepristone |
| 4110976 | −0.36 | danazol |
| 5208013 | −0.76 | Mifepristone |
| 5208013 | −0.99 | MAH |
| 5208013 | −0.51 | danazol |
| 4543123 | −1.20 | Mifepristone |
| 4543123 | 1.27 | prednisone |
| 5426158 | −0.93 | Mifepristone |
| 5426158 | −1.03 | dexamethasone |

TABLE 19

| | | |
|---|---|---|
| 3715059 | −0.75 | Mifepristone |
| 3715059 | −0.66 | MAH |
| 3715059 | −0.77 | donazol |
| 5208013 | −0.76 | Mifepristone |
| 5208013 | −0.99 | MAH |
| 5208013 | −0.51 | donazol |
| 619447 | 0.81 | MAH |
| 619447 | 0.33 | betamethasone |
| 1824860 | 0.77 | MAH |
| 1824860 | 0.70 | betamethasone |
| 3729593 | 0.41 | MAH |
| 3729593 | 0.55 | betamethasone |
| 5521873 | 1.19 | MAH |
| 5521873 | 0.77 | betamethasone |
| 419492 | 1.07 | MAH |
| 419492 | 1.08 | dexamethasone |
| 494905 | 0.91 | MAH |
| 494905 | 0.75 | dexamethasone |
| 508943 | −0.93 | MAH |
| 508943 | −1.26 | dexamethasone |
| 869702 | 0.88 | MAH |
| 869702 | 0.55 | dexamethasone |
| 1259841 | 1.09 | MAH |
| 1259841 | 0.84 | dexamethasone |
| 1501410 | −1.03 | MAH |
| 1501410 | −1.16 | dexamethasone |
| 1501410 | −0.98 | dexamethasone |
| 1857664 | −0.92 | MAH |
| 1857664 | −0.71 | dexamethasone |
| 2025128 | 0.93 | MAH |
| 2025128 | 0.90 | dexamethasone |
| 2025128 | 1.20 | dexamethasone |
| 1946155 | 0.64 | MAH |
| 1946155 | 0.92 | prednisone |
| 1946155 | 0.93 | dexamethasone |
| 2173002 | 0.99 | MAH |
| 2173002 | 0.75 | dexamethasone |
| 2173002 | 0.98 | dexamethasone |
| 2293496 | −0.89 | MAH |
| 2293496 | −0.82 | dexamethasone |
| 2698777 | −0.99 | MAH |
| 2698777 | −1.25 | prednisone |
| 2698777 | −1.48 | dexamethasone |
| 3115505 | −0.94 | MAH |
| 3115505 | −1.10 | dexamethasone |
| 4377432 | 1.13 | MAH |
| 4377432 | 0.87 | dexamethasone |
| 4884214 | −1.09 | MAH |
| 4884214 | −0.77 | dexamethasone |
| 622565 | 1.20 | MAH |
| 622565 | 1.20 | budesonide |
| 622565 | 1.17 | betamethasone |
| 686993 | 0.36 | MAH |
| 686993 | 0.51 | budesonide |
| 686993 | 0.51 | betamethasone |
| 1401312 | −1.06 | MAH |
| 1401312 | −1.09 | budesonide |
| 1401312 | −0.82 | prednisone |
| 1611629 | 0.89 | MAH |
| 1611629 | 1.19 | budesonide |
| 1611629 | 0.94 | prednisone |
| 1716458 | 1.09 | MAH |
| 1716458 | 1.24 | budesonide |
| 1716458 | 1.03 | prednisone |
| 1973123 | −0.93 | MAH |
| 1973123 | −1.23 | budesonide |
| 2057513 | 0.92 | MAH |
| 2057513 | 1.13 | budesonide |
| 2078880 | −1.14 | MAH |
| 2078880 | −0.80 | budesonide |
| 2078880 | −0.75 | betamethasone |
| 2173973 | 1.04 | MAH |
| 2173973 | 1.08 | budesonide |
| 2173973 | 0.81 | betamethasone |
| 2227273 | 1.37 | MAH |
| 2227273 | 1.05 | budesonide |
| 2227273 | 1.01 | prednisone |
| 2434746 | 0.49 | MAH |
| 2434746 | 0.42 | budesonide |
| 2434746 | 1.46 | betamethasone |
| 3426776 | 0.81 | MAH |
| 3426776 | 0.61 | budesonide |
| 3449615 | 0.76 | MAH |
| 3449615 | 1.05 | budesonide |
| 3497137 | −0.88 | MAH |
| 3497137 | −0.94 | budesonide |
| 3721985 | −1.05 | MAH |
| 3721985 | −1.10 | budesonide |
| 3770530 | −0.89 | MAH |
| 3770530 | −0.98 | budesonide |
| 4252872 | 1.13 | MAH |
| 4252872 | 1.24 | budesonide |
| 4252872 | 0.77 | prednisone |
| 4630674 | 0.87 | MAH |
| 4630674 | 0.97 | budesonide |
| 4630674 | 0.86 | prednisone |
| 5038177 | 0.77 | MAH |
| 5038177 | 0.57 | budesonide |
| 5038177 | 0.74 | danazol |
| 998615 | 0.85 | MAH |
| 998615 | 0.91 | prednisone |
| 1740179 | 1.04 | MAH |
| 1740179 | 0.86 | prednisone |
| 2908212 | 0.46 | MAH |
| 2908212 | 0.42 | prednisone |
| 400654 | 1.06 | beclomethasone |
| 400654 | 1.15 | MAH |
| 517374 | 0.40 | beclomethasone |
| 517374 | 1.00 | MAH |
| 517374 | 1.04 | budesonide |
| 654246 | −0.95 | beclomethasone |
| 654246 | −1.22 | MAH |
| 654246 | −1.08 | budesonide |
| 668460 | 1.23 | beclomethasone |
| 668400 | 1.28 | MAH |
| 963331 | −1.01 | beclomethasone |
| 963331 | −1.03 | MAH |
| 1573840 | 0.97 | beclomethasone |
| 1573840 | 0.90 | MAH |
| 1573840 | 0.86 | dexamethasone |
| 1604437 | 0.47 | beclomethasone |
| 1604437 | 1.18 | MAH |
| 1604437 | 1.18 | budesonide |
| 1697719 | −0.69 | beclomethasone |
| 1697719 | −0.86 | MAH |
| 1697719 | −0.81 | budesonide |
| 1723834 | 0.47 | beclomethasone |
| 1723834 | 0.72 | MAH |
| 1857044 | 0.61 | beclomethasone |
| 1857044 | 0.96 | MAH |
| 1857044 | 0.89 | betamethasone |
| 1995520 | 0.82 | beclomethasone |
| 1995520 | 1.09 | MAH |
| 2046717 | 0.98 | beclomethasone |
| 2046717 | 1.52 | MAH |
| 2046717 | 0.83 | betamethasone |
| 2372040 | −1.05 | beclomethasone |
| 2372040 | −1.21 | MAH |
| 2506425 | 0.88 | beclomethasone |
| 2506425 | 1.38 | MAH |
| 2636759 | 0.51 | beclomethasone |
| 2636759 | 0.93 | MAH |
| 2695371 | 0.51 | beclomethasone |
| 2695371 | 0.70 | MAH |
| 2695371 | 0.95 | betamethasone |
| 2947188 | −1.02 | beclomethasone |
| 2947188 | −1.09 | MAH |
| 2947188 | −0.98 | dexamethasone |
| 3047143 | 1.10 | beclomethasone |
| 3047143 | 1.08 | MAH |
| 3057272 | 0.83 | beclomethasone |
| 3057272 | 0.99 | MAH |
| 3057272 | 0.98 | dexamethasone |
| 3687607 | 1.03 | beclomethasone |
| 3687607 | 1.05 | MAH |
| 3687607 | 1.17 | budesonide |
| 3960194 | 1.00 | beclomethasone |
| 3960194 | 1.17 | MAH |

TABLE 19-continued

| Clone ID | Ave DE [log2] (C3A treated with steroid) | Steroid |
|---|---|---|
| 3960194 | 1.01 | prednisone |
| 4087621 | 0.89 | beclomethasone |
| 4087621 | 1.01 | MAH |
| 4087621 | 1.09 | betamethasone |
| 4253663 | −0.70 | beclomethasone |
| 4253663 | −0.96 | MAH |
| 4284270 | −0.70 | beclomethasone |
| 4284270 | −0.96 | MAH |
| 4284270 | −0.88 | dexamethasone |
| 4863677 | 1.09 | beclomethasone |
| 4863677 | 1.12 | MAH |
| 4863677 | 1.11 | budesonide |
| 4894508 | −0.93 | beclomethasone |
| 4894508 | −0.99 | MAH |
| 4894508 | −1.03 | prednisone |
| 5398701 | 0.82 | beclomethasone |
| 5398701 | 1.09 | MAH |
| 5398701 | 1.10 | betamethasone |

TABLE 19

| Clone ID | Ave DE [log2] (C3A treated with steroid) | Steroid |
|---|---|---|
| 167081 | −1.12 | progesterone |
| 167081 | −1.00 | MAH |
| 167081 | −1.10 | dexamethasone |
| 1679683 | 0.25 | progesterone |
| 1683583 | 0.59 | MAH |
| 986919 | 0.65 | progesterone |
| 1986919 | 0.84 | MAH |
| 2266959 | 0.96 | progesterone |
| 2266959 | 0.29 | MAH |
| 2499905 | 1.24 | progesterone |
| 2499905 | 1.11 | MAH |
| 3220149 | 0.53 | progesterone |
| 3220149 | 0.31 | MAH |
| 3408804 | −1.16 | progesterone |
| 3408804 | −1.49 | MAH |
| 3408804 | −1.24 | budesonide |
| 5045593 | −1.02 | progesterone |
| 5045593 | −1.03 | MAH |
| 1398105 | −0.76 | Mifepristone |
| 1398105 | −0.68 | MAH |
| 2890141 | −0.71 | Mifepristone |
| 2890141 | −0.95 | MAH |
| 2890141 | −0.70 | danazol |

TABLE 20

| Clone ID | Ave DE [log2] (C3A treated with steroid) | Steroid |
|---|---|---|
| 1781411 | −0.98 | Mifepristone |
| 1781411 | −0.74 | danazol |
| 2890141 | −0.71 | Mifepristone |
| 2890141 | −0.95 | MAH |
| 2890141 | −0.70 | danazol |
| 3715059 | −0.75 | Mifepristone |
| 3715059 | −0.66 | MAH |
| 3715059 | −0.77 | danazol |
| 4110976 | −0.17 | Mifepristone |
| 4110976 | −0.36 | danazol |
| 5208013 | −0.76 | Mifepristone |
| 5208013 | −0.99 | MAH |
| 5208013 | −0.51 | danazol |
| 2407620 | 0.02 | betamethasone |
| 2407620 | −0.26 | danazol |
| 3474091 | 0.23 | betamethasone |
| 3474091 | −0.29 | danazol |
| 1500810 | −0.70 | dexamethasone |
| 1500810 | −0.41 | danazol |

TABLE 20-continued

| Clone ID | Ave DE [log2] (C3A treated with steroid) | Steroid |
|---|---|---|
| 2607834 | 0.29 | prednisone |
| 2607834 | 0.92 | danazol |
| 5038177 | 0.77 | MAH |
| 5038177 | 0.57 | budesonide |
| 5038177 | 0.74 | danazol |

TABLE 21

| Clone ID | Ave DE [log2] (C3A teested with steroid) | Steroid |
|---|---|---|
| 1275616 | 0.94 | beclomethasone |
| 1275616 | 0.97 | dexamethasone |
| 1323616 | 1.09 | beclomethasone |
| 1323616 | 0.89 | dexamethasone |
| 1573840 | 0.97 | beclomethasone |
| 1573840 | 0.90 | MAH |
| 1573840 | 0.86 | dexamethasone |
| 1876829 | −1.00 | beclomethasone |
| 1876829 | −1.13 | budesonide |
| 1876829 | −0.94 | dexamethasone |
| 2086783 | −0.88 | beclomethasone |
| 2086783 | −1.13 | prednisone |
| 2086783 | −1.18 | dexamethasone |
| 2095329 | −0.99 | beclomethasone |
| 2095329 | −1.21 | prednisone |
| 2095329 | −1.37 | dexamethasone |
| 2285181 | −0.88 | beclomethasone |
| 2285181 | −1.27 | dexamethasone |
| 2287703 | −0.99 | beclomethasone |
| 2287703 | −1.07 | prednisone |
| 2287703 | −1.24 | dexamethasone |
| 2287724 | −1.05 | beclomethasone |
| 2287724 | −1.06 | budesonide |
| 2287724 | −1.16 | dexamethasone |
| 2294968 | −0.73 | beclomethasone |
| 2294968 | −0.94 | dexamethasone |
| 2947188 | −1.02 | beclomethasone |
| 2947188 | −1.09 | MAH |
| 2947188 | −0.98 | dexamethasone |
| 3057272 | 0.83 | beclomethasone |
| 3057272 | 0.99 | MAH |
| 3057272 | 0.98 | dexamethasone |
| 3973887 | −0.91 | beclomethasone |
| 3973887 | −1.06 | dexamethasone |
| 4284270 | −0.70 | beclomethasone |
| 4284270 | −0.96 | MAH |
| 4284270 | −0.88 | dexamethasone |
| 5091002 | −1.13 | beclomethasone |
| 5091002 | −1.22 | prednisone |
| 5091002 | −1.42 | dexamethasone |
| 1946155 | 0.64 | MAH |
| 1946155 | 0.92 | prednisone |
| 1946155 | 0.93 | dexamethasone |
| 2088104 | −1.15 | prednisone |
| 2088104 | −1.20 | dexamethasone |
| 2252884 | −1.03 | prednisone |
| 2252884 | −0.19 | dexamethasone |
| 2253102 | −1.13 | prednisone |
| 2253102 | −1.20 | dexamethasane |
| 2269058 | −1.06 | prednisone |
| 2269058 | −1.15 | dexamethasone |
| 2285521 | −1.09 | prednisone |
| 2285521 | −1.22 | dexamethasone |
| 2698777 | −0.99 | MAH |
| 2698777 | −1.25 | prednisone |
| 2698777 | −1.48 | dexamethasone |
| 380006 | −1.05 | budesonide |
| 380006 | −0.98 | dexamethasone |
| 1823946 | −1.10 | budesonide |
| 1823946 | −1.20 | dexamethasone |

TABLE 21-continued

| Clone ID | Ave DE [log2] (C3A teested with steroid) | Steroid |
|---|---|---|
| 1930847 | −1.09 | budesonide |
| 1930847 | −0.67 | dexamethasone |
| 2703282 | −1.01 | budesonide |
| 2703282 | −0.86 | dexamethasone |
| 2703282 | −0.85 | betamethasone |
| 3139631 | −0.97 | budesonide |
| 3139631 | −0.82 | dexamethasone |
| 4089291 | −1.00 | budesonide |
| 4089291 | −0.77 | dexamethasone |
| 419492 | 1.07 | MAH |
| 419492 | 1.08 | dexamethasone |
| 494905 | 0.91 | MAH |
| 494905 | 0.75 | dexamethasone |
| 508943 | −0.93 | MAH |
| 508943 | −1.26 | dexamethasone |
| 869702 | 0.88 | MAH |
| 869702 | 0.55 | dexamethasone |
| 1259841 | 1.09 | MAH |
| 1259841 | 0.84 | dexamethasone |
| 1501410 | −1.03 | MAH |
| 1501410 | −1.16 | dexamethasone |
| 1501410 | −0.98 | betamethasone |
| 1857664 | −0.92 | MAH |
| 1857664 | −0.71 | dexamethasone |
| 2025128 | 0.93 | MAH |
| 2025128 | 0.90 | dexamethasone |
| 2025128 | 1.20 | betamethasone |
| 2173002 | 0.99 | MAH |
| 2173002 | 0.75 | dexamethasone |
| 2173002 | 0.98 | betamethasone |
| 2293496 | −0.89 | MAH |
| 2293496 | −0.82 | dexamethasone |
| 3115505 | −0.94 | MAH |
| 3115505 | −1.10 | dexamethasone |
| 4377432 | 1.13 | MAH |
| 4377432 | 0.87 | dexamethasone |
| 4884214 | −1.09 | MAH |
| 4884214 | −0.77 | dexamethasone |
| 167081 | −1.12 | progesterone |
| 167081 | −1.00 | MAH |
| 167081 | −1.10 | dexamethasone |
| 2655279 | −1.03 | progesterone |
| 2655279 | −1.21 | dexamethasone |
| 5206821 | 0.17 | dexamethasone |
| 5206821 | 0.50 | betamethasone |
| 220378 | 0.39 | dexamethasone |
| 220378 | 0.57 | betamethasone |
| 1500810 | −0.70 | dexamethasone |
| 1500810 | −0.41 | danazol |
| 5426158 | −0.93 | Mifepristone |
| 5426158 | −1.03 | dexamethasone |

TABLE 22

| Clone ID | Ave DE [log2] (C3A treated witn steroid) | Steroid |
|---|---|---|
| 622565 | 1.20 | MAH |
| 622565 | 1.20 | budesonide |
| 622565 | 1.1 7 | betamethasone |
| 686993 | 0.36 | MAH |
| 686993 | 0.51 | budesonide |
| 686993 | 0.51 | betamethasone |
| 689296 | 1.08 | budesonide |
| 689296 | 1.12 | betamethasone |
| 1798594 | 0.69 | budesonide |
| 1798594 | 1.37 | betamethasone |
| 2078880 | −1.14 | MAH |
| 2078880 | −0.80 | budesonide |
| 2078880 | −0.75 | betamethasone |
| 2170820 | 1.17 | budesonide |

TABLE 22-continued

| Clone ID | Ave DE [log2] (C3A treated witn steroid) | Steroid |
|---|---|---|
| 2170820 | 1.30 | betamethasone |
| 2173973 | 1.04 | MAH |
| 2173973 | 1.08 | budesonide |
| 2173973 | 0.81 | betamethasone |
| 2189061 | 0.15 | budesonide |
| 2189061 | 0.23 | betamethasone |
| 2222155 | 0.58 | budesonide |
| 2222155 | 0.50 | betamethasone |
| 2343836 | 0.93 | budesonide |
| 2343836 | 0.63 | betamethasone |
| 2404746 | 0.40 | MAH |
| 2404746 | 0.42 | budesonide |
| 2404746 | 1.46 | betamethasone |
| 2482388 | 1.19 | budesonide |
| 2482388 | 1.14 | betamethasone |
| 2660756 | 1.13 | budesonide |
| 2660756 | 1.26 | betamethasone |
| 2687356 | 1.26 | budesonide |
| 2687356 | 1.23 | betamethasone |
| 2703282 | −1.01 | budesonide |
| 2703282 | −0.86 | dexamethasone |
| 2703282 | −0.85 | betamethasone |
| 3229449 | 0.39 | budesonide |
| 3229449 | 1.05 | betamethasone |
| 4403805 | 1.12 | budesonide |
| 4403805 | 1.19 | betamethasone |
| 615776 | 1.01 | beclomethasone |
| 615776 | 1.06 | budesonide |
| 615776 | 1.11 | betamethasone |
| 1329625 | 0.35 | beclomethasone |
| 1329625 | 0.42 | prednisone |
| 1329625 | 0.91 | betamethasone |
| 1857044 | 0.61 | beclomethasone |
| 1857044 | 0.96 | MAH |
| 1857044 | 0.89 | betamethasone |
| 1951845 | 1.01 | beclomethasone |
| 1951845 | 0.79 | prednisone |
| 1951845 | 1.02 | betamethasone |
| 2046717 | 0.98 | beclomethasone |
| 2046717 | 1.52 | MAH |
| 2046717 | 0.83 | betamethasone |
| 2430165 | 1.04 | beclomethasone |
| 2430165 | 0.23 | prednisone |
| 2430165 | 0.68 | betamethasone |
| 2695371 | 0.51 | beclomethasone |
| 2695371 | 0.70 | MAH |
| 2695371 | 0.95 | betamethasone |
| 3973687 | 1.23 | beclomethasone |
| 3973687 | 1.31 | budesonide |
| 3973687 | 1.47 | betamethasone |
| 4087621 | 0.89 | beclomethasone |
| 4087621 | 1.01 | MAH |
| 4087621 | 1.09 | betamethasone |
| 4215034 | 1.13 | beclomethasone |
| 4215034 | 1.20 | budesonide |
| 4215034 | 1.50 | betamethasone |
| 4855265 | 1.00 | beclomethasone |
| 4855265 | 1.14 | budesonide |
| 4855265 | 1.24 | betamethasone |
| 5398701 | 0.82 | beclomethasane |
| 5398701 | 1.09 | MAH |
| 5398701 | 1.10 | betamethasone |
| 5543385 | 1.00 | prednisone |
| 5543385 | 1.15 | betamethasone |
| 1496011 | 0.51 | prednisone |
| 1496011 | 0.60 | betamethasone |
| 2734007 | 0.88 | prednisone |
| 2734007 | 1.04 | betamethasone |
| 220378 | 0.39 | dexamethasone |
| 220378 | 0.57 | betamethasone |
| 2025128 | 0.93 | MAH |
| 2025128 | 0.90 | dexamethasone |
| 2025128 | 1.20 | betamethasone |
| 2173002 | 0.99 | MAH |
| 2173002 | 0.75 | dexamethasone |

TABLE 22-continued

| Clone ID | Ave DE [log2] (C3A treated witn steroid) | Steroid |
|---|---|---|
| 2173002 | 0.98 | betamethasone |
| 5206821 | 0.17 | dexamethasone |
| 5206821 | 0.50 | betamethasone |
| 1323327 | 0.83 | progesterone |
| 1323327 | 1.00 | betamethasone |
| 1600180 | 1.06 | progesterone |
| 1600180 | 0.77 | betamethasone |
| 1816768 | 0.28 | progesterone |
| 1816768 | 0.24 | betamethasone |
| 2753065 | 0.78 | progesterone |
| 2753065 | 0.75 | betamethasone |
| 3528232 | 0.99 | progesterone |
| 3528232 | 0.38 | beclomethasone |
| 3528232 | 0.80 | betamethasone |
| 3876612 | 0.26 | progesterone |
| 3876612 | 0.19 | betamethasone |
| 5521873 | 1.19 | MAH |
| 5521873 | 0.77 | betamethasone |
| 619447 | 0.81 | MAH |
| 619447 | 0.33 | betamethasone |
| 1824860 | 0.77 | MAH |
| 1824860 | 0.70 | betamethasone |
| 3729593 | 0.41 | MAH |
| 3729593 | 0.55 | betamethasone |
| 2407620 | 0.02 | betamethasone |
| 2407620 | −0.26 | donozol |
| 3474091 | 0.23 | betamethasone |
| 3474091 | −0.29 | donozol |

TABLE 23

| Clone ID | Ave DE [log2] (C3A treated with steroid) | Steroid |
|---|---|---|
| 1275616 | 0.94 | beclomethasone |
| 1275616 | 0.97 | dexamethasone |
| 1323616 | 1.09 | beclomethasone |
| 1323616 | 0.89 | dexamethasone |
| 1573840 | 0.97 | beclomethasone |
| 1573840 | 0.90 | MAH |
| 1573840 | 0.86 | dexamethasone |
| 1876829 | −1.00 | beclomethasone |
| 1876829 | −1.13 | budetonide |
| 1876829 | −0.94 | dexamethasone |
| 2086783 | −0.88 | beclomethosone |
| 2086783 | −1.13 | prednisone |
| 2086783 | −1.18 | dexamethasone |
| 2095329 | −0.99 | beclomethasone |
| 2095329 | −1.21 | prednisone |
| 2095329 | −1.37 | dexomethasone |
| 2287724 | −1.05 | beclomethasone |
| 2287724 | −1.06 | budesonide |
| 2287724 | −1.16 | dexamethasone |
| 2285181 | −0.88 | beclomethasone |
| 2285181 | −1.27 | dexomethasone |
| 2287703 | −0.99 | beclomethasone |
| 2287703 | −1.07 | prednisone |
| 2287703 | −1.24 | dexamethasone |
| 2294968 | −0.73 | beclomethasone |
| 2294968 | −0.94 | dexomethasone |
| 2947188 | −1.02 | beclomethasone |
| 2947188 | −1.09 | MAH |
| 2947188 | −0.98 | dexomethasone |
| 3057272 | 0.83 | beclomethasone |
| 3057272 | 0.99 | MAH |
| 3057272 | 0.98 | dexamethasone |
| 3973887 | −0.91 | beclcomethasone |
| 3973887 | −1.06 | dexomethasone |
| 4284270 | −0.70 | beclomethasone |
| 4284270 | −0.96 | MAH |
| 4284270 | −0.88 | dexomethasone |

TABLE 23-continued

| Clone ID | Ave DE [log2] (C3A treated with steroid) | Steroid |
|---|---|---|
| 5091002 | −1.13 | beclomethasone |
| 5091002 | −1.22 | prednisone |
| 5091002 | −1.42 | dexomethasone |
| 615776 | 1.01 | beclomethasone |
| 615776 | 1.06 | budesonide |
| 615776 | 1.11 | betamethasone |
| 1329625 | 0.35 | beclomethasone |
| 1329625 | 0.42 | prednisone |
| 1329625 | 0.91 | betamethasone |
| 1857044 | 0.61 | beclomethasone |
| 1857044 | 0.96 | MAH |
| 1857044 | 0.89 | betamethasone |
| 1951845 | 1.01 | beclomethasone |
| 1951845 | 0.79 | prednisone |
| 1951845 | 1.02 | betamethasone |
| 2046717 | 0.98 | beclomethasone |
| 2046717 | 1.52 | MAH |
| 2046717 | 0.83 | betamethasone |
| 3528232 | 0.99 | progesterone |
| 3528232 | 0.38 | beclomethasone |
| 3528232 | 0.80 | betamethasone |
| 2430165 | 1.04 | beclomethasone |
| 2430165 | 0.23 | prednisone |
| 2430165 | 0.68 | betamethasone |
| 2695371 | 0.51 | beclomethasone |
| 2695371 | 0.70 | MAH |
| 2695371 | 0.95 | betamethasone |
| 3973687 | 1.23 | beclomethasone |
| 3973687 | 1.31 | budesonide |
| 3973687 | 1.47 | betamethasone |
| 4087621 | 0.89 | beclomethasone |
| 4087621 | 1.01 | MAH |
| 4087621 | 1.09 | betamethasone |
| 4215034 | 1.13 | beclomethasone |
| 4215034 | 1.20 | budesonide |
| 4215034 | 1.50 | betamethasone |
| 4855265 | 1.00 | beclomethasone |
| 4855265 | 1.14 | budesonide |
| 4855265 | 1.24 | betamethasone |
| 5398701 | 0.82 | beclomethasone |
| 5398701 | 1.09 | MAH |
| 5398701 | 1.10 | betamethasone |
| 517374 | 0.40 | beclomethasone |
| 517374 | 1.00 | MAH |
| 517374 | 1.04 | budesonide |
| 654246 | −0.95 | beclomethasone |
| 654246 | −1.22 | MAH |
| 654246 | −1.08 | budesonide |
| 1604437 | 0.47 | beclomethasone |
| 1604437 | 1.18 | MAH |
| 1604437 | 1.18 | budesonide |
| 1662870 | −0.76 | beclomethasone |
| 1662870 | −0.93 | budesonide |
| 1697719 | −0.69 | beclomethasone |
| 1697719 | −0.86 | MAH |
| 1697719 | −0.81 | budesonide |
| 3687607 | 1.03 | beclomethasone |
| 3687607 | 1.05 | MAH |
| 3687607 | 1.17 | budesonide |
| 4863677 | 1.09 | beclomethasone |
| 4863677 | 1.12 | MAH |
| 4863677 | 1.11 | budesonide |
| 3960194 | 1.00 | beclomethasone |
| 3960194 | 1.17 | MAH |
| 3960194 | 1.01 | prednisone |
| 4894508 | −0.93 | beclomethasone |
| 4894508 | −0.99 | MAH |
| 4894508 | −1.03 | prednisone |
| 400654 | 1.06 | beclomethasone |
| 400654 | 1.15 | MAH |
| 668460 | 1.23 | beclomethasone |
| 668460 | 1.28 | MAH |
| 963331 | −1.01 | beclomethasone |
| 963331 | −1.03 | MAH |
| 1723834 | 0.47 | beclomethasone |

TABLE 23-continued

| Clone ID | Ave DE [log2] (C3A treated with steroid) | Steroid |
|---|---|---|
| 1723834 | 0.72 | MAH |
| 1995520 | 0.82 | beclomethasone |
| 1995520 | 1.09 | MAH |
| 2372040 | −1.05 | beclomethasone |
| 2372040 | −1.21 | MAH |
| 2506425 | 0.88 | beclomethasone |
| 2506425 | 1.38 | MAH |
| 2636759 | 0.81 | beclomethasone |
| 2636759 | 0.93 | MAH |
| 3047143 | 1.10 | beclomethasone |
| 3047143 | 1.08 | MAH |
| 4253663 | −0.70 | beclomethasone |
| 4253663 | −0.96 | MAH |

TABLE 24

| Clone ID | Ave DE [log2] (C3A treated with steroid) | Steroid |
|---|---|---|
| 622565 | 1.20 | MAH |
| 622565 | 1.20 | budesonide |
| 622565 | 1.17 | betamethasone |
| 686993 | 0.36 | MAH |
| 686993 | 0.51 | budesonide |
| 686993 | 0.51 | betamethasone |
| 689296 | 1.05 | budesonide |
| 689296 | 1.12 | betamethasone |
| 1798594 | 0.69 | budesonide |
| 1798594 | 1.37 | betamethasone |
| 2078880 | −1.14 | MAH |
| 2078880 | −0.80 | budesonide |
| 2078880 | −0.75 | betamethasone |
| 2170820 | 1.17 | budesonide |
| 2170820 | 1.30 | betamethasone |
| 2173973 | 1.04 | MAH |
| 2173973 | 1.08 | budesonide |
| 2173973 | 0.81 | betamethasone |
| 2189061 | 0.15 | budesonide |
| 2189061 | 0.23 | betamethasone |
| 2222155 | 0.58 | budesonide |
| 2222155 | 0.50 | betamethasone |
| 2343836 | 0.93 | budesonide |
| 2343836 | 0.63 | betamethasone |
| 2404746 | 0.49 | MAH |
| 2404746 | 0.42 | budesonide |
| 2404746 | 1.46 | betamethasone |
| 2482388 | 1.19 | budesonide |
| 2482388 | 1.14 | betamethasone |
| 2660756 | 1.13 | budesonide |
| 2660756 | 1.26 | betamethasone |
| 2687356 | 1.26 | budesonide |
| 2687356 | 1.23 | betamethasone |
| 3229449 | 0.39 | budesonide |
| 3229449 | 1.05 | betamethasone |
| 4403805 | 1.12 | budesonide |
| 4403805 | 1.19 | betamethasone |
| 380006 | −1.05 | budesonide |
| 380006 | −0.98 | dexamethasone |
| 1823946 | −1.10 | budesonide |
| 1823946 | −1.20 | dexamethasone |
| 1930847 | −1.09 | budesonide |
| 1930847 | −0.67 | dexamethasone |
| 3139631 | −0.97 | budesonide |
| 3139631 | −0.82 | dexamethasone |
| 2703282 | −1.01 | budesonide |
| 2703282 | −0.86 | dexamethasone |
| 2703282 | −0.85 | betamethasone |
| 4089291 | −1.00 | budesonide |
| 4089291 | −0.77 | dexamethasone |
| 517374 | 0.40 | beclomethasone |
| 517374 | 1.00 | MAH |
| 517374 | 1.04 | budesonide |
| 615776 | 1.01 | beclomethasone |
| 615776 | 1.06 | budesonide |
| 615776 | 1.11 | betamethasone |
| 654246 | −0.95 | beclomethasone |
| 654246 | −1.22 | MAH |
| 654246 | −1.08 | budesonide |
| 1604437 | 0.47 | beclomethasone |
| 1604437 | 1.18 | MAH |
| 1604437 | 1.18 | budesonide |
| 1662870 | −0.76 | beclomethasone |
| 1662870 | −0.93 | budesonide |
| 1697719 | −0.69 | beclomethasone |
| 1697719 | −0.86 | MAH |
| 1697719 | −0.81 | budesonide |
| 1876829 | −1.00 | beclomethasone |
| 1876829 | −1.13 | budesonide |
| 1876829 | −0.94 | dexamethasone |
| 2287724 | −1.05 | beclomethasone |
| 2287724 | −1.06 | budesonide |
| 2287724 | −1.16 | dexamethasone |
| 3687607 | 1.03 | beclomethasone |
| 3687607 | 1.05 | MAH |
| 3687607 | 1.17 | budesonide |
| 3973687 | 1.23 | beclomethasone |
| 3973687 | 1.31 | budesonide |
| 3973687 | 1.47 | betamethasone |
| 4215034 | 1.13 | beclomethasone |
| 4215034 | 1.20 | budesonide |
| 4215034 | 1.50 | betamethasone |
| 4855265 | 1.00 | beclomethasone |
| 4855265 | 1.14 | budesonide |
| 4855265 | 1.24 | betamethasone |
| 4863677 | 1.09 | beclomethasone |
| 4863677 | 1.12 | MAH |
| 4863677 | 1.11 | budesonide |
| 1401312 | −1.06 | MAH |
| 1401312 | −1.09 | budesonide |
| 1401312 | −0.82 | prednisone |
| 1611629 | 0.89 | MAH |
| 1611629 | 1.19 | budesonide |
| 1611629 | 0.94 | prednisone |
| 1679595 | 1.10 | budesonide |
| 1679595 | 0.99 | prednisone |
| 1716458 | 1.09 | MAH |
| 1716458 | 1.24 | budesonide |
| 1716458 | 1.03 | prednisone |
| 2227273 | 1.37 | MAH |
| 2227273 | 1.05 | budesonide |
| 2227273 | 1.01 | prednisone |
| 4252872 | 1.13 | MAH |
| 4252872 | 1.24 | budesonide |
| 4252872 | 0.77 | prednisone |
| 4630674 | 0.87 | MAH |
| 4630674 | 0.97 | budesonide |
| 4630674 | 0.86 | prednisone |
| 5102951 | 0.84 | budesonide |
| 5102951 | 0.85 | prednisone |
| 5326983 | 0.94 | budesonide |
| 5326983 | 0.50 | prednisone |
| 1973123 | −0.93 | MAH |
| 1973123 | −1.23 | budesonide |
| 2057513 | 0.92 | MAH |
| 2057513 | 1.13 | budesonide |
| 3426776 | 0.81 | MAH |
| 3426776 | 0.61 | budesonide |
| 3449615 | 0.76 | MAH |
| 3449615 | 1.05 | budesonide |
| 3497137 | −0.88 | MAH |
| 3497137 | −0.94 | budesonide |
| 3721985 | −1.05 | MAH |
| 3721985 | −1.10 | budesonide |
| 3770530 | −0.89 | MAH |
| 3770530 | −0.98 | budesonide |
| 3408804 | −1.16 | progesterone |

TABLE 24-continued

| Clone ID | Ave DE [log2] (C3A treated with steroid) | Steroid |
|---|---|---|
| 3408804 | −1.49 | MAH |
| 3408804 | −1.24 | budesonide |
| 5038177 | 0.77 | MAH |
| 5038177 | 0.57 | budesonide |
| 5038177 | 0.74 | danazol |

TABLE 25

| Clone ID | Ave DE [log2] (C3A treated with steroid) | Steroid |
|---|---|---|
| 1401312 | −1.06 | MAH |
| 1401312 | −1.09 | budesonide |
| 1401312 | −0.82 | prednisone |
| 1611629 | 0.89 | MAH |
| 1611629 | 1.19 | budesonide |
| 1611629 | 0.94 | prednisone |
| 1679595 | 1.10 | budesonide |
| 1679595 | 0.99 | prednisone |
| 1716458 | 1.09 | MAH |
| 1716458 | 1.24 | budesonide |
| 1716458 | 1.03 | prednisone |
| 2227273 | 1.37 | MAH |
| 2227273 | 1.05 | budesonide |
| 2227273 | 1.01 | prednisone |
| 4252872 | 1.13 | MAH |
| 4252872 | 1.24 | budesonide |
| 4252872 | 0.77 | prednisone |
| 4630674 | 0.87 | MAH |
| 4630674 | 0.97 | budesonide |
| 4630674 | 0.86 | prednisone |
| 5102951 | 0.84 | budesonide |
| 5102951 | 0.85 | prednisone |
| 5326983 | 0.94 | budesonide |
| 5326983 | 0.50 | prednisone |
| 1946155 | 0.64 | MAH |
| 1946155 | 0.92 | prednisone |
| 1946155 | 0.93 | dexamethasone |
| 2088104 | −1.15 | prednisone |
| 2088104 | −1.20 | dexamethasone |
| 2252884 | −1.03 | prednisone |
| 2252884 | −1.19 | dexamethasone |
| 2253102 | −1.13 | prednisone |
| 2253102 | −1.20 | dexamethasone |
| 2269058 | −1.06 | prednisone |
| 2269058 | −1.15 | dexamethasone |
| 2285521 | −1.09 | prednisone |
| 2285521 | −1.22 | dexamethasone |
| 2698777 | −0.99 | MAH |
| 2698777 | −1.25 | prednisone |
| 2698777 | −1.48 | dexamethasone |
| 1329625 | 0.35 | beclomethasone |
| 1329625 | 0.42 | prednisone |
| 1329625 | 0.91 | betamethasone |
| 1951845 | 1.01 | beclomethasone |
| 1951845 | 0.79 | prednisone |
| 1951845 | 1.02 | betamethasone |
| 2086783 | −0.88 | beclomethasone |
| 2086783 | −1.13 | prednisone |
| 2086783 | −1.18 | dexamethasone |
| 2095329 | −0.99 | beclomethasone |
| 2095329 | −1.21 | prednisone |
| 2095329 | −1.37 | dexamethasone |
| 2287703 | −0.99 | beclomethasone |
| 2287703 | −1.07 | prednisone |
| 2287703 | −1.24 | dexamethasone |
| 2430165 | 1.04 | beclomethasone |
| 2430165 | 0.23 | prednisone |
| 2430165 | 0.68 | betamethasone |
| 3960194 | 1.00 | beclomethasone |
| 3960194 | 1.17 | MAH |
| 3960194 | 1.01 | prednisone |
| 4894508 | −0.93 | beclomethasone |
| 4894508 | −0.99 | MAH |
| 4894508 | −1.03 | prednisone |
| 5091002 | −1.13 | beclomethasone |
| 5091002 | −1.22 | prednisone |
| 5091002 | −1.42 | dexamethasone |
| 1496011 | 0.51 | prednisone |
| 1496011 | 0.60 | betamethasone |
| 2734007 | 0.88 | prednisone |
| 2734007 | 1.04 | betamethasone |
| 5543385 | 1.00 | prednisone |
| 5543385 | 1.15 | betamethasone |
| 998615 | 0.85 | MAH |
| 998615 | 0.91 | prednisone |
| 1740179 | 1.04 | MAH |
| 1740179 | 0.86 | prednisone |
| 2908212 | 0.46 | MAH |
| 2908212 | 0.42 | prednisone |
| 4543123 | −1.20 | Mifepristone |
| 4543123 | 1.27 | prednisone |
| 2607834 | 0.29 | prednisone |
| 2607834 | 0.92 | danazol |

SEQUENCE LISTING (1143 sequences)

SEQ ID NO: 1 - DNA, 1581 bp, Homo sapiens
  misc_feature: Incyte ID No: 230040.1
aaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgatggacctgcggctgctgcccaggtctgcagggaggccggacccgcagtcgcagctgccagagcgcaccggtgctgagtggaacccccctctctccttcagcctggcctcccggggacttgagtggccagtactgtgaccctaagacaaccgctctggggagctgcacacttcagctcaggagatcgacagggaggccctgtggtgttgaagggggtggagggactgcgtgaagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcgcctgtaaacacccgactggccatagagcatcctgctgtggacccagatgtaggcattaatggggtacagacctatcgcttactggactaccagtggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaaatggaccaggctgcatccctgctgtaatcactgctcttgtgtccattattaaagttattttcagaccccctgaaattgtccctcgttacatagcaaacgagatagatggtgttgtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatg

SEQ ID NO: 2 - DNA, 335 bp, Homo sapiens
  misc_feature: Incyte ID No: 175138.1
  unsure 94, 133: a, t, c, g, or other
tacagataatagttatcaatattaaagttttaactcttgggcagagacagactatgtgaatttcaggtcataccagctcaaaatcatccttganttcggatgtgcatatttcatggtaacgtttatatataantaggatacaaagcagcaaacattttcctgtctcacatctagttcaacaagttttgcctagaaatgtggataaaaattgaacattgttttacccagctgccagcaaaaaggtttgtcatgccatttgttcaaattatagtacccttgaatttggtacccaagtatgaatcattagaatagccagagagggctgggcgcacgtg

SEQ ID NO: 3 - DNA, 4261 bp, Homo sapiens
  misc_feature: Incyte ID No: 1863336CB1
taatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggactgttaccttggcttggtcagggactgtctgtca

SEQ ID NO: 4 - protein, 1207 aa, Homo sapiens
  misc_feature: Incyte ID No: 1863336CD1
MEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 5 - DNA, 2538 bp, Homo sapiens
  misc_feature: Incyte ID No: 343861.16
  unsure 927, 2327: a, t, c, g, or other
ggaggaagaggcggtagggggtacgggggctggtcccagaagatggcggaggcgggggatttctgctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggaataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacntacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggttaagagtctgtttttcttctttgtggtaagtcttagaatatggtactgtggattaatctaatgaaattaacatatgtggttgaagttaccaagaaacgatgaaaagaaactaaatatagtngacccttgaacaacaggagttaggggcaccactccccaacatagttgaaaatccatgtataacttttgactcctccaaaacttaactactaatagcctactcttgatgggaagccttaccaataagaaacagttgatgaacacatattgtgtatggtatatgtattatatactgttttcttacaatagtgtaagtctaaggaaaaaaaaaa

SEQ ID NO: 6 - DNA, 1010 bp, Homo sapiens
  misc_feature: Incyte ID No: 3170236CB1
  unsure 994, 1002, 1005: a, t, c, g, or other
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagacagagactcnccgtctcnttncatcc

SEQ ID NO: 7 - protein, 300 aa, Homo sapiens
  misc_feature: Incyte ID No: 3170236CD1
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 8 - DNA, 1255 bp, Homo sapiens
  misc_feature: Incyte ID No: 259805.54
ctgaagcatagtagaggtgaaatgcttttccaaaggttaataaacataacgtctacagtagagtcttcagttaacctcttacattcgttttatgagcaagcaggctttctccattaataccacattttcatggtattgaataactcaggttgaacagtctttcctgaagcctttctattcttcccactcctaatacgatggcctacttttttggggtttttgtggggaagggactggtgtatcattgtcagagaaaagagaaaccatatttaaccagggccttagcagggcatgagcacagtcacagccacttgctcttgaccttgtgctttgatttcagtttaacacttctaaatttttgtactgcttcctcattctcctcttttgccaggctctggggaagatatagttcatcgacctttttaagagtatctcgttttctttgtagcatcatttccctttctaatgtgcaggagaaaagaagtacctgctttcagacttgccctctagccaggaaaagcactaagcctttggtgcaaaggagaggaaactatttggtatagaaatacagaaaaatttccatagatttttgttaataagctgcaatctgttgtcttcccaaaaaaaatgaggtatatttgagaaacatcttcttgagaggtcactttggtctctatagaatgttttctcctgacattttcttctgtgctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatggaagcttcttcatggagtaaaaaatgtatttaaaagaaaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtatggcatgttagggataagtgcttatttttaagagctgtggagttct

SEQ ID NO: 9 - DNA, 2753 bp, Homo sapiens
  misc_feature: Incyte ID No: 1460258CB1
cgcggaattccgcggaattccgcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaaaaaa

SEQ ID NO: 10 - protein, 863 aa, Homo sapiens
  misc_feature: Incyte ID No: 1460258CD1
MQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 11 - DNA, 3526 bp, Homo sapiens
  misc_feature: Incyte ID No: 1016903.1
cgccgccggagtcctcgccccgccgcgctgcgcccggctcgcgctgcgctagtcgctccgcttcccacaccccgccggggactggcagccgccgccgcacatctgccgccacagcctccgccggctacccgaacgttctcggggccagcgccgagtggatcaccggggaccgcgaggcacccgcgcgccgcagaccccgcgcgggctggagcacccggcagagcgcgccacagcgccgtggcctctgctgcccgggctgcgccagagccgcggacgggcgcgcagagcgccggggactccggagccgatccctagcgccgcgatgcggagcacctactgcaggagatcgggggcctgggacgcgctggccgaggtgtgatcggaccccaggctagccacaaagggcacttggccccagggctaggagagcgaggggagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgcccttcctggacccggcgtcgcccaggatggctgccccgagccatgggccgcggcggagctagcgcggagcgcccgaccctcgacccccgagtcccggagccggccccgcgcggggccacgcgtccctcgggcgctggttcctaaggaggacgacagcaccagcttctcctttctcccttcccttccctgccccgcactcctccccctgctcgctgttgttgtgtgtcagcacttggctggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggc

SEQ ID NO: 12 - DNA, 3315 bp, Homo sapiens
  misc_feature: Incyte ID No: 065385.7
  unsure 3279, 3281, 3293, 3300, 3303: a, t, c, g, or other
tttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattatttttgtgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtatttcctcagcaatatacatgccttctcgataggttagtcccccgacaacaggagttcctgtggctggagccagtgtagggtcaaatgcatcaatatcaaaactcaaatggattggtctttgtctcctaaaaaggaagaggataaaataatacttaaaataatacttaactggttgtccttggacactcatccttcttatggttgcaactccttgattttgttgctattagtcctagtactttgttaataaagctgttaatacatttccaggcttcctattcttggaagttactgagattggcaatattaacttcctacataccacttcatgatactgccatttgttctgcatacctcagacagactaactccaatgtatatttctgccttacactgggtattagaacctcttatactaataactgtcaatagagagatttcttcacttctagatgagattgggctctcatctagagacaatttaattagacaatttaaattagtctaatttaaattggcttgatgtaagttatggttgctcttattctctgaacgtaacagcagctgaagtgaactctaattttaggtctgcagttttaacatcttccatttctaacttcattatagccccagtgtccaaaggctgaagctaacaactaagtttcttaacagcttatgaaatgacatactaccagataacaattctgacattaatcacccagaagtaaagacttggtattgggaaaatgctcttaaaattaccatttgattagtattcatctgccatctttctacactgccaagatttgcttaatataaaactcagatgaaacaatcgtgaggctgggaagaatgggacagttgaaacaataaatgcttgtcatctcagaagataagcattaaagatggagataaagaaaaattcatgagacagaagatctaggcaatgatttagaggaaacctcctcccaaaaaccccagaggaagaatatgacctgtgtttcaaattttgcctttctgaactatttaaaattatgtgtatgtttttgctttgtattttaaaagtaaagctgctgtcctcaagaaacaggctaaaagtgtgttgcccattgggggtttgccctgacatcagttatagttacttacttgccaatcagcagatcaaatgttcgttccatgaccttctggataccaagtcgatcaatatctctcatggaaaaatactggatatcatagttctttaaaataaaactgtgatgagatataaagggaggagtccttagtttaaagagcatttttaacaaatatgtattagagcgananggtgggtttgtngtagtgnccngcaatagaccaa

SEQ ID NO: 13 - DNA, 460 bp, Homo sapiens
  misc_feature: Incyte ID No: 003714.1
aaactccgttctccaaaaaaaaaaaattatatcctcaccacatgccccctaccattgctttacagataaggaaaccaatgctctgggggactgggtgggttgcccaagggcatctgatgagaaagttgtaacaatgaacagaacaggattcctgctcttgggatgtctttgaaacaggagcctcgtgaactcctaattcatctgtccaggtttcactctgatacccttcttgggggaaatcttccctgcctcctccaccccgcagagttccttagtcttgcacacaagacgcttcgtgacccagcccctgctgtatcatcttgttactctcctcctccagtcacctcaagacctgtggtatccctgaccacaatacctatacttcatgccgttgcacgtgcaatccctctgcctgtatcacctaatcccactacctcagactgcctgaaaaactctgttc

SEQ ID NO: 14 - DNA, 7626 bp, Homo sapiens
  misc_feature: Incyte ID No: 1720920CB1
atgcagtccggccgcggccccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactggtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgacggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggccggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcccggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccagtccaacccaggccagcctttgtctctgccccagagttgagaaaaaaacttcctcccctgggttttttagggagatggtatcccctggagtagagggcaagaggagagagcgctccagtctagaaggcataagccaataggatgatatattcagggtgcaagggtggtaggttgctctggggatgggcttatttaaggaggatgcaaggaagctatttaat

SEQ ID NO: 15 - protein, 2322 aa, Homo sapiens
  misc_feature: Incyte ID No: 1720920CD1
MQSGRGPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGAHYGELELDILGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHCGGPAQDLTFRVSDGLQASPPATLKVVAIRPAIQIHRSTGLRLAQGSAMPILPANLSVETNAVGQDVSVLFRVTGALQFGELQKHSTGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPDGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPEDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGPLQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 16 - DNA, 7316 bp, Homo sapiens
  misc_feature: Incyte ID No: 256009.48
cgggcagacccgcccgcccgagccggagttacaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtcctcttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttgaatctgaaaggtcccaaagtcaaaggggatgtggatgtgtctttgccaaaaggtggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggggctgcatggctgaccttgggctgagctggctcctgtcccaggagagagagaagctggggaaggggtttacaggtgggcctgggaaatggcgagcctgggggtggtggtgcctggggacc

SEQ ID NO: 17 - DNA, 197 bp, Homo sapiens
  misc_feature: Incyte ID No: 1055233.1
aagagattgacccagcttgcagaagaggacctgaagtctcaggacaaaccgtggacctcctgcaatctgctggaatcaattggagacttgttattttaccgaggctgtgagagaaatggcatattttcagatatgtccagattactttgaggaattaaggttgactttttagacccgaaaggaagcctcttggaaag

SEQ ID NO: 18 - DNA, 1580 bp, Homo sapiens
  misc_feature: Incyte ID No: 2114865CB1
cagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctgcagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacaaaaaaaaaaaaaa

SEQ ID NO: 19 - protein, 423 aa, Homo sapiens
  misc_feature: Incyte ID No: 2114865CD1
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPADTQNIFFMSKVTNPKQA

SEQ ID NO: 20 - DNA, 1316 bp, Homo sapiens
  misc_feature: Incyte ID No: 1383740.1
  unsure 48: a, t, c, g, or other
tgactatataccatggaaaagccaccactctgccacttaaataaacancaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactacactctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctgtaaaaatgtcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaa

SEQ ID NO: 21 - DNA, 10432 bp, Homo sapiens
  misc_feature: Incyte ID No: 2700132CB1
tggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggctggaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacctagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtctcaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcagtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacagatctgtctttccaatggccggggggatttggtccccaaattaaggctattggacatctgcacaggacagtcta

SEQ ID NO: 22 - protein, 3256 aa, Homo sapiens
  misc_feature: Incyte ID No: 2700132CD1
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQSGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGWKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDLDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRLRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 23 - DNA, 761 bp, Homo sapiens
  misc_feature: Incyte ID No: 231621.1
  unsure 529-613: a, t, c, g, or other
cttttaaataaaaaataaaaccccaataacttttgttctaattcataagacttaatagcagagttatattattttttcatcatgttattcattcatacaataacacataattgtgtgttttttgcatgtcactagcttagttgtgaaataattcctacttcttcccctcatagaatgaaagagattcatgagtaggtaataatagcatattcttataattgaaatgatagaattattatgtgagtgcttaacctagcttaattatgcagagaaggcttgctggaggaggtggcaccagaaatgtgtatttgaggatttgatcagcaaatggaacattctcagcagagggaaaatgaacacaaagatagggaagtgagaaatttaatggcatgattagaggctaacacatattttacagaggatgaaggacatgggagacgggactggctctgtaatttgcagggcctcgtgcaagaaaatgcagagcttcttgttaagaagtgattcatgatgactgcagagcagagannnnnnnnnnnnnnnnnnnnnnnnnnnnnnnnnnnnnnnnnnnnnnnnnnnnnnnnnnnnnnnnnnnnnnnnnnnnnnnnnnnnnatagctagaggtgctagtagtaagttggagatgtagactatgaagaaagaagaattgagatttgtaagctttctacttgagggcttaggtgatattgacgcaaccaacagaaatagaggctataagatggagaatggtcccattgtgg

SEQ ID NO: 24 - DNA, 1598 bp, Homo sapiens
  misc_feature: Incyte ID No: 216485.1
tcattactttattgttaaaaatgtgtcagttgtaaagatacctgtccttagaatcagcatgttgggaggtgcaggagattcctgcctttgaacacctgcctaaagattccataacaaggggatttggtatgatgagatatatgcaaaaggtttggattctggaaaaatatatacaagtctttttccagggggggaaaatacacacacacacacacacacacacccctaaggagtccagtgtaattgtgtttctcaaattcctgtttctcaaatacaaagttttaggagaataagacaatttaggaaaatcaacacattattcatgtcccgtaaaacaccaagattgtttttctattttcctgagttatatcaatagaaaaaacataaaatgataattagtctccctgtcacttcatcagagttttatagattagtaattttcatgtatagcacatttatgatataacttatacccttatttattggagatgattttattagatgatacctgcagactatggaaaaaaaaatcttttctaagctttctatatgaggtggtcattagaatgcttcatgggatttttgaaaacatttctaatattccagcctctgacaataagcactttttcctctatgacattaatttactccttaaagttttctcttcagctataatcttaaggtaaatgggaaatagacataagtgcatttaaatttataatgcactgattctcttgtgaaggtagtcttgtaatgaggaaggaattcaaaacagaacttgtttgcagctctgcaaatgtgcaagaaagctacaaacctgccaatattccattcacatttagctacacatttctgagacacatctatctttactagagggcaggatttgctatctctctggagtagcatatgcataataaagatggacagagattgataattacttgcatcaaaatgatgctttctttgtgtacctaaatttaggaacaaaatgttagaaaattgtttcaaaagtacctaggttaaaaataccaactatatcaaacctaatctacttattctcctgctctcctcatccaccgcttcataccttctcatcctcaagccacaagtactttttctcctatcttcctttgcagtgttacttactatttccctgagaaatagaagtaatcagaggacttccacagaccacctccccccaccaccatatagagtcacctacttgtaactgtgccttgtattctctgtcttccatctgttcttatgaatgaaatgttccgagctgtatccttgcaacttgtgcactagatcccattccttcccctactcaaagagtgattcagcaactttctcctctcccctgcagcatcactcccaccctctctattgggtcattcccacaaccagcttggtggaagcaacaatcagcccgctcccggattcttgcagtagcctcctacctggtctccttttagcccctggctccctttcactttattttcatcgcaatagccagaatgattccattaaaatccactcttgctcagaaccctccagaggcttctcattcactaagtataaaagttaaaatctct

SEQ ID NO: 25 - DNA, 388 bp, Homo sapiens
  misc_feature: Incyte ID No: 406004.2
aataggcattgtgttagatgattttgcccaactgtgggctgatttaagtgttctgagcacatttaggttaggctgggttgagctaggttcagtaggtcacatgtattaaaatgcatttttaatttataataagttcatccagatgcaacttcatcataaattgaggaacatctgtactgttaattccaatcaaaatcatgagttaaattagcttaattttcaaagttggatatttatttgagcaacaggagtggaacagggatcaacgtgttacagttaccctccttctgggctagtgagacagcctccagtgtgttctgactcagccacacctctgaacccctttccacatttagccactgttataattaatctactcaggtccaat

SEQ ID NO: 26 - DNA, 1727 bp, Homo sapiens
  misc_feature: Incyte ID No: 1399930.1
  unsure 363: a, t, c, g, or other
tggggatcccttttgactgctagacattcctggacaggcaggcgttcccacttccttcttaagtatttcctatccctttgctgttgacttccagtattctctcttggatgatctatttgaagtgtgattatctactcaccactgtggttcttcttggtggaggcggcaactactaaatgcttctagtcagctgtcctgaagtgcctgttggaatttggtgcttaaaataattcttagttgatttccaattttgtttggtttttctgtgttctcctttagttctttgagtgtattttgaagtctttagtacatctgatgctttaggttaagggacagtttctgcacattttttcctatgaatanaccatgttttgttctttgtatgccttgtaattttttgttgaaaactggacatctgaaaaacagccaagtttcccagtctttgcagactggctccatgccaggaagggacctccactcactagtaagatgtgttctgacctttagcatcatcccacgatgaagccccaaagaccctccaggactttgcttggtaagggtcttgcctgaggccctgtgtgtatttgtttttattctgttacaccacgcttttaaattttttacttttccaaagagtcttcctgtaccttgttctagtccataggtctgcagtcctgcagctttcagttacccaccactttctatggcttttccaaggctgcgctctacgtataccacttttcctcatccaagctccaagttaggcaaaacagagaccagttcttcagcagcccccaaaatgttgcaaataagatctgtcctgctccctcctacttgagggaggtcactggtacctgggctgctgcttcctcccaacactaccacactgtggagagggtggggcaagcctgagtaaaactaccacaaaatttcttaccattttgaatgtgacttttccttgattgggcattagcttggttcttgtagacctttgcctttcagagttcccataaagttttctttagtcagtctctacttgtaatctttccatggggaatgaagacatgtagctgcctattcttcttgctgctgtatagtccaagcacagtgcaaaaataaaatgtacagcataacaagttattttacaacagacacatgtaatcataatgcaactcaaaaaacagaacatttgtaaaacttagtaagttccctgcttaccaaatcactgatatccctcgccctcccttcccaaagctgaccattattttaactttgtgggcaatgatgtctttgctttgctttatactttaacagttatgtatacatccctaaacaaaatataataatcttgcctgtttgggaactataaacagaaacgtatgttacatatccttttgtctgattctttaatgtttttaccaatgttttttccatataaaggtatcttttctccttgtatttatttctttttatgaatatactgctgtcaacttgtctatttatgtttaagatttagaatggctggatataggaatatgtatattgtcagttgcactaactaatgccaaagttttccatagtggtttttaccagcaatatatgggagctcatttatgcataccttctccaattagccaatctggtggacagtatgttcattttcatgtatttatttgccatttgggtttttcttctgttaagggctaataaaaatattttgttttcct

SEQ ID NO: 27 - DNA, 2708 bp, Homo sapiens
  misc_feature: Incyte ID No: 414171.33
cttggagagagcagacttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaagggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgc

SEQ ID NO: 28 - DNA, 1771 bp, Homo sapiens
  misc_feature: Incyte ID No: 230895.1
aatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcatggatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaa

SEQ ID NO: 29 - DNA, 592 bp, Homo sapiens
  misc_feature: Incyte ID No: 022827.1
gagtttccgcttgcactccaccccggtagcagctccgcggcagggacagcttcctccggacgcttggcgggcttcgctctcgccttacgacagcccggtcggatcatgggtttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaag

SEQ ID NO: 30 - DNA, 1097 bp, Homo sapiens
  misc_feature: Incyte ID No: 346663.6
aataaattgaagatggccatgctgtaacttctaaacatggtttgcttctcagatttacctaaactaagaaaggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttaatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcctctgtattccagccaaatcc

SEQ ID NO: 31 - DNA, 550 bp, Homo sapiens
  misc_feature: Incyte ID No: 096422.1
gaataacagttcaaaagaatgagtggggataacagaggaccagactttaatgttaagaaatttggaaaataagaaatgtgtcagaatatccagatttctttcctctgttgaaaatgggatgatgtggaaaatatgaccccacatttctgcatggcatcagcagctggggctgaataattgatttgtattatcctccctgtactacctccaccctccctaacctgatccatttagacaggctatgcactcttcagctcaccaatatctccgtcagactggttttactcattcatatcacctgcctatactccaaaggcattcaagtttgccagtcctggtatatgcccatgcatatagatattaccaatatttctacctcccactgatgggtagtaacccctgccttgagcaaatctagtttttcccctaattgtatttgggaaattcagccagcattttcatgagatgatattgggtccattggtaaatctgaatctgactttctcacctagagaaataaggggacagatggtactgagaatgacaaata

SEQ ID NO: 32 - DNA, 683 bp, Homo sapiens
  misc_feature: Incyte ID No: 405833.1
  unsure 603: a, t, c, g, or other
gatatactgaacccaacgcctatcctccagccccctaagaactagagagggagcctcacaacattccaatttaatccttcagaaaattcattactcttcaaagttgtctgtggttttgtgacaacgatatgactaggtgcaaaatggcttgcaactaattaacaaacatagaagcatccaacaaacatatacgtgcacaatctgaggatttagggatgaaatcagttatccaggttagatatcaacaaaagagcagtaattataaagtttcatgaagaaagtggctgttgaggtgtggattatgtaaggtaaggactgacccaacaaagaaatgattttgttataatccagaagtaaaactaaataaatgttctttaaattgatggataaataagaaagaatttatttacaacagtaaataaatccaatacttgttataaataagataaagctggctataaattcacattttcatgtgagcgttttgaagtatgtggacataaaaaacacacacctcaagcatacttctcaatgatttctggataaagaacacacctttgtaaccagcacatggtgtaaaaccagaaacagaacattaccagnttcctaaacaagccttctttgtgtccctttttagtcactaccctcccccattcaaggtaacttctatcttgacttctaac

SEQ ID NO: 33 - DNA, 404 bp, Homo sapiens
  misc_feature: Incyte ID No: 995839.2
  unsure 363, 384: a, t, c, g, or other
cctccaagtcccagcgaacccgcgtgcaacctgtcccgactctagccgcctcttcagctcgccatggatcccaactggctcctgcgccgccggtgactcctgcacctgcgccggctcctgcaaatgcaaagagtggcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaaccgtggaccgtttgctatattccctttttctatgganataatgtggaatggataatanaaacagcttttgacttgaaa

SEQ ID NO: 34 - DNA, 852 bp, Homo sapiens
  misc_feature: Incyte ID No: 2517374CB1
agacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggttcaggacagagacttgggggccatcctgcccctccaacccgacatgtgtacctcagctttttccctcacttgcatcaataaagcttctgtgtttggaacagctaaaaaaaaaaa

SEQ ID NO: 35 - protein, 201 aa, Homo sapiens
  misc_feature: Incyte ID No: 2517374CD1
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 36 - DNA, 835 bp, Homo sapiens
  misc_feature: Incyte ID No: 1255456CB1
cggcctcgccgcgctcacggcctcgcctcggtatcgcagcgggtcctctctatctagctcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaa

SEQ ID NO: 37 - protein, 146 aa, Homo sapiens
  misc_feature: Incyte ID No: 1255456CD1
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 38 - DNA, 421 bp, Homo sapiens
  misc_feature: Incyte ID No: 003084.1
  unsure 361-363, 366-367, 373: a, t, c, g, or other
gtgtcagggtctatgaaatgggctcagactggcacacttgcattacttttgatccagcagagtgagtataaggttgtagatactctgtgatgctgctagttggctcagaattatacagctaaaataaatgtggctttcctcttagtacttgtaagctttacttcctaaaaaaagagctcaaagttatataaagtttcatcaccatttatttgttgcattcctttaattaagataatctatccttagaacaaaatttcaaagaaaattattttctatgaaagtttttctgttttgttggtacaggattgtgaaattaaggaagaaggcaaaatacactcccttgttttgcacaactgtcgcnnntgnncagacnggtggggtggttttccaagctgccaatgttaaatctagtgcccacctc

SEQ ID NO: 39 - DNA, 260 bp, Homo sapiens
  misc_feature: Incyte ID No: 302123.12
  unsure 17: a, t, c, g, or other
gttaccaccaagagctngaaatcaggccaataacccaccagccaatgctctccgaggaggagccagccaccctggaaggcatcctagggccaacaaccatcctgcctcctcctcgagttttcctcggaaacactcttgaatgtctgagtgagggtcctgcttagctctttggcctgtgagatgctttgaaaatttttatttttttaagatgaagcaagatgtctgtaacggtaattgcctcacattaaactgtcgccaga

SEQ ID NO: 40 - DNA, 2308 bp, Homo sapiens
  misc_feature: Incyte ID No: 533825CB1
cgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacatcactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaggaccccggtgaatctctcggcatggccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaatataggctaagaagttgaaacactatatttatcttgtccagttttatatttaaagaaagaatacattgtaaaaatgtcaggaaaagtatgatcatctaatgaaagccagttacacctcagaaaatatgattcc

SEQ ID NO: 41 - protein, 632 aa, Homo sapiens
  misc_feature: Incyte ID No: 533825CD1
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENITAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMAVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 42 - DNA, 584 bp, Homo sapiens
  misc_feature: Incyte ID No: 220845.2
gaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaaggtaagagcaagtcccaaaggtcatttatgacacagctttctaataacttacgcgttggggactgtaggaggaagatgtcagaaattctcaagttttgaaaactacacagttatattgattccatggtattcatgtcacagattctatacacacagaccagacgttttttaatgatagagcaaaagctttttaagaccatagactaacaataatgtttgtttggagcatagggctcagtcttgaatgtttggcactctaacctcaagaggttttttcagagctcactttgcctttagatatttgtaacaaataagaggacttttaacttgcactttgcgaagtaagcaactcacattcatatactatagtgaaggtaccagattaggaggaacttggtctatttcttatcaaaactatagaggaagg

SEQ ID NO: 43 - DNA, 2208 bp, Homo sapiens
  misc_feature: Incyte ID No: 985475.8
cggctcgagcggctcgaggccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgccctgagatgagttgagcttgtttcttctcagtttccccagtcaggatgagggagtaggtagaggactatgtgatgccccttttctaaggaagaagccatagccttttcaaaggtagcagccagaggggtggaccctagccttgtctctggcagcacctctgcagcctcttccgccatctggtgtccattccccacctggaagtgaggttttgtgttccgatccccttgatagattcccctccttcccctgagcatcctgaccctatcagcctatcccatctcatgcccaccccaggtactcagacaccgacaggagtttgtggtgaccccagcgtcaggtggcacgttaggcaccaagtgtggacttgccagtctcctgactccactgttagatcattttccttgggtgtgggggcggggcggggcgcggcggggagacggggtagcaaaaagaaccgtgaagaaaccacgcctgcccccttcagccttttcccccctccgccgcatttttccatctccccttgagtgagtggatgtcccgttgccttttctcagctttgcgcgacgtggtcccacaaccgttgcctttttaagagaggcccggcccatccccaccatgcctcccttcctggctgtgtccatggctgtgatggcattctccactcagcagttctctagcatcccacacccaggtctcactgaaagaaaggggaacaggccatggcagtcagtgcttacagaggttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatggagaaataaaacagagcatatgatgtatagagaaaatgaactgcacccagctgtgcactagagcgccatgttcttacccagcattccttgccacggtgtgaaccacagcagggaagctcgcatggttctacacgtcaccgaggcctggatgaaaatgtggcctcacgatgtgtatggttgggacccg

SEQ ID NO: 44 - DNA, 401 bp, Homo sapiens
  misc_feature: Incyte ID No: 198309.7
gcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctcctccagtccaactgatggcccagatgcagcaggaggccagaggacagagcagaggatctttccaaccacatctgctggctctggggtcccagtg

SEQ ID NO: 45 - DNA, 2807 bp, Homo sapiens
  misc_feature: Incyte ID No: 1382869.18
gccagtgtgctggaaaggtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatatggtggtggaggacctggatatggcaaccagggtgggggctaccggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaacctttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggatttgtgagtagacagattacaattctattttaaatacaagttttataaaataaatactttt

SEQ ID NO: 46 - DNA, 1799 bp, Homo sapiens
  misc_feature: Incyte ID No: 1382869.1
agaaaactttagaaactgttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggcttggcttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaaggtgttgaacatttat

SEQ ID NO: 47 - DNA, 538 bp, Homo sapiens
  misc_feature: Incyte ID No: 352049.1
gaataaaaatcattgtttgaatcaaaatatgtttctgaggaagggataaaaggaatttatttccaaaagaaccctcttcttttggaactttagatttgtttctctgactgcaaagcatggttttgttcctggaccaaactgagggtcaggctgctatttctcgtggcccaataacaagatgcaggtcaactgggaaggaagagagtttttatttctgtaagtggctccagggagaaggcctggaaattatcaccagaccaacgcaaaattagaaagttttccagagcttatataccttctaagctatacgtctacgtgttaagtgtgcactcatctaaagacataagtgattaacttcttttaatctataattaaggcctgagtcctgaagaccttcccctggagcctcagtaaactgacttaatcttgtttcctgctaaatcatgaaggtttggggagttccttcgggctcccaataaacttgtctgtggaggcctggagagtttcttcagacctccaataaacttgtttaatcctt

SEQ ID NO: 48 - DNA, 5233 bp, Homo sapiens
  misc_feature: Incyte ID No: 215990.2
tcagcctgaacatggatgaagttttttgtttttaagagcttccttagtgattgttataggagcctcctagacaagtctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaaa

SEQ ID NO: 49 - DNA, 2135 bp, Homo sapiens
  misc_feature: Incyte ID No: 428335.59
  unsure 1815, 2132: a, t, c, g, or other
gaaaaaaaatgggtttgtgatcctgttattcagagacagaatcaccctcttccctctccactccccataaacacaaccacagtctcacgtacactggggtttaggaggcgggcggacggcaccgggcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcattgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccgggccgtggcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaagtgcacagcttccccacactcaagttctttcctgccagtgccgacaggacggtcatcgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccagcncctcttccaggcatgggggacaccctgacaggaagaggagctggtggctgccagccctgggtcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctganaaa

SEQ ID NO: 50 - DNA, 1577 bp, Homo sapiens
  misc_feature: Incyte ID No: 1561192CB1
tcgagctgtaggggaggcgctgcgcccccggccccagccgatcgggggctcctggcgctagctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctgggggctcctccccaggcagccaaatgggccccagacaagccttttgtggggaacaagaacctcccgcatccgtgagtttttgtgaccataaggaggccttctaatttgaggctgctggtaccccaggattttatatgtaggttccctttggaagcctgtatttttagggcctcaatcaattcctttaaagtcaagggtgggatgggaaccctattttgctttgtttattggttgtgctgtgttatattttgatgtggggtaagaacgtttcctatattttggtgtgttttgtttcaatataaataaggtgtttt

SEQ ID NO: 51 - protein, 217 aa, Homo sapiens
  misc_feature: Incyte ID No: 1561192CD1
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 52 - DNA, 1538 bp, Homo sapiens
  misc_feature: Incyte ID No: 1330151.46
ggcggagggcggagtggtgcctttaaaaggccgggcgccgccttccgcctgcccgcctcctgcgccgccccttccgagggctaaatcggctgcgttcctctcggaacgcgccgcaggaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggg

SEQ ID NO: 53 - DNA, 1990 bp, Homo sapiens
  misc_feature: Incyte ID No: 1330151.49
ggaagccccaggccttcgtaagtctggctgggcgagaagtggccgaaggagccatcccaggagagagctggggcggctggaagctgggcgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaaggggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaagagccgggcaagcagcctggagtcccga

SEQ ID NO: 54 - DNA, 1055 bp, Homo sapiens
  misc_feature: Incyte ID No: 404028.1
  unsure 355, 449, 451, 902: a, t, c, g, or other
aaatattaagaactgttatataactataaaaagtatcagcttaaaagctaaaagcctttgaaaaaagaagacagaggaaggaagaaaaaagaaaactggcatagcaaccagaacaattttataccttctcaagaatgttctgtcatgaaaataaattgataatttttttctgttacattacagtttggtttctagccatccagttgatttagcaggagaatgcaggttttttttagcagctttgaattggtaaacagatttagatgtagtagaaaggaacatgaggaagttgtttttttttttaacatccaatctttcccagcatatgcacataagaaggtgaatgaagcaatgngaaacttacttctctttagtcaagtgaaaaaaaggctaaacatttgttagatggtaaaatattgtgtcaagcgagtaggcaaattccaaaattncncagtggttgatacattaacatcctcaaatatttgagcatgcacttcctttgagatctgtaaattaaatcaccagtgggttagataaaaatacaaaacaaatggcaatctaaccatctcagaaaaggttcaggtttttttctccctaaaactgagaacttgctaaataatttttgaaaagcataaacgtaatacaccctgggttacgatcgagggcagaagggaaggcatttccaaggctcctgctgtagtgtttttcccatttttgttaatacctcaaaaactcccagagatgactttattcctggcccctgcagagctcccctccccacccccaccttgtagactgtaacagattgcaccacatggtgtctgtttaaaaaaaaaaaaaaaattcccatagggacctggatatcccattaatgggctttatgttcctcatggcaaattagntttacacaggaatttccaaacattgttttctgttaagaagggagggtaccatatataatgtatattttttctacaattagtaggaatcagacagggaaagggaagtgtcatctattcatacctttctctccaaattcagtgttctttcccata

SEQ ID NO: 55 - DNA, 2492 bp, Homo sapiens
  misc_feature: Incyte ID No: 996427.2
aatcactcattttccttttctgactgaattaagggagattatatgaattgtttataaaataggtctctggtacacatttgttgttcactttaatgattttttcactaaccccacctgttatttttagactgactcttatcataagttttgcctttataaattctgagttaaataaaatgaccaattgtagtcatgaccaggcatgaagattccatccctgaggggtaaagcagtagactactgccagctccacttcagttcaggccacatcaccctcagtcctgaaggagaccccttcttagcctccagttgttgcactgcaactctgcctcgaattgggctatgcccgagtatcctcagagtttagatgggcagtgtatttttgcttaagtagaagaatgtagttgtgccactgagaaggataaccagaaaaggttagatatatttgtcagttcacttttactcaaatttccattgagttacttaagaaatcagttcttcaaagtggatatgtacattacagactctgtcacctacacatacacaggaatcttttgaagaataagatctgggtaatactggagtaggatgtaggaaggttaatgttgtatagatgatgttttaaagatagagtttcagcatatatgttaataactttttctcctattttctcaaggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgggaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcataaaa

SEQ ID NO: 56 - DNA, 838 bp, Homo sapiens
  misc_feature: Incyte ID No: 021971.1
  unsure 698, 705, 716: a, t, c, g, or other
caccagtgaaaaagtcccccatggctgtcagacctaaagtaaagcctaggcagggaaaagaagcaggggcggggcagggagcgggggaggggagaggagggggagggaaaggccaattctgccatcctcctctgccacctgccagtgtcctggaagaaacatgctgagaagcgcatgcagtgtggtgttctgccttttgtttttctgttcaataaggaattttcaggtgttcctacagcagtgtctacttaggtcatctctgaccgaagtcacactcaagaagcaggctgtggaactgctgggttagcaaacgctttcagtaaactgactttcaaagggagggaagtggaacttctttaatgtagaaacctccacacacggtctctgtctgtgtctgatcttctgccatggtttgttccaaaactcagcttgtctttccaaatagcctagacagaacaagtttttacaagtgcacattgaaagtacattgagagaaaccccagaatgtgtatgccctatcatggaggaagtaaggtcattcttaacagagtaataattgctcacaatttactggcaaagtctttttcttcctaaattagtgttttctgtataccatcttctctcagtggttccatagttattcagaattcctgttaactttttttttttaagtgaaagcaagtttattaagaaagtgngaggaangaaagaatggntactccataggcacagcagccctgttaactttgaaacctcagagtttatagctatgaaaagaaagaagaagaatgacatgaacaggttgagggatttgctgaggctcacataattcacatgc

SEQ ID NO: 57 - DNA, 574 bp, Homo sapiens
  misc_feature: Incyte ID No: 215205.1
gattgattctcctcttcttggagtctatcgaccaggggctcggggtgggtggctgtccagacaccctgtgctcctctccagaaggaagtcttatgagaccactgctctcccagagggcagaggaagctgctcagctctcacagcatccacaggaccccccaaaacccctgcccaatcctgggtctgagtccctcctctgaatacacaaggcctgaagacacagcgttcagaggaaggagctcagacctccccgatcaaatggtatcttctttgaaagaatatggcgccacatttggggttgtcaactgcggccaggtcagtacgtcttcactttgatcaattgcggccagatcaatacgtctgcactctgattcccacgtgtctatgcctccctgctcctcaatgcagggccctggatgaaaggagtgagtgctgagttttgtctaaatccaatccttgcaagagtcactgaaagtagcattataaattgtttgcaagaggcctttgacactgaaaacttggccatgtgactgttgtccaaaaatcctgctttcacatctatgagttgcttatt

SEQ ID NO: 58 - DNA, 1283 bp, Homo sapiens
  misc_feature: Incyte ID No: 400650.3
cggccgcaaatgtttccctcatatctgcatcgtaaatttctttttattcttacagaatagctagagatcaccagtttaagaaatcctacaagactttttccatgagagctatgcactctctctccagcatcacctctccatctgcttttcacgatgcatttcttacactggaatgtgataaaaccgtacactgtacttagcccttccctgtaaaggggcaatgagctgtttaagggtaaaggggtagttactaagcccatgccatcgtctgtattaagtcttatttttgtatttctacaagggtggaaagagagcctgttaagtgaatgtacctgtaatgaacaagttcatgccaaacagtggagtagctttcaattattttggagccaaagaccttcacttcattctggagtattgaacacaagatggtcattggaaatgttggaaactggtttttttcctacatcagtaaaagcataccacacttcattttaaaatgtaatacagagttatagaaaatatattcaaggcccaagtgacaaattggtaaatagcgaaaagaatcagagcttgaacaatttacttagttcttctgagcacacttttccaacctgcgacatggggacaatgagggctgcccaagacgactgtgttaaggatctgtgataatttatatgatgcatctagtacagtgttggacttaaaagaaactcataatatttgagaatatatgcaaatgctggattttcatggaatgacagacacccctttactcacattgattaagcagtgcaattacaacatagacatgagaagagaatctgagaagacacctctatttgtgggtaccggcatgagcaaacactaaaggaaattttcccagaggactgtaatccacctccaacactaatgaaagaactttgtaagcatacacgtccaagtgttaaccttttaattggtgacaatctccttattatgaaagttttaagaggtacttagtgtgccataacattttgtcataagtgtataattcagtaactttcagtcaattgttagagctgtgcaaccactgccacaattcaattttagaatatttccatcaccccgaaaaggcttcatgtgccaatttacagacatcctctattttcaccccaacctccaggcagccattctttcttctgtagataagcaagccatcagtaacttccttgccagcaaagttgatcctgatttatgatttttctgatactttaagtaaagagaaagaaaagtcatagggaaga

SEQ ID NO: 59 - DNA, 3836 bp, Homo sapiens
  misc_feature: Incyte ID No: 344524.1
  unsure 834, 946, 3201, 3614-3638: a, t, c, g, or other
ctcatctttaaaatggggagagaaatattaactcagagggttgtggggagacctgaattagagtatgccccatggagcaactggtgaatggaaggtgcctcaagtcccacaggtgtgttcctcactccctctagtaacaaaacagtgcagtcggcctgcccacacttgcagtttacatcctagatcccaaccaactgcagatcaaaaatgttcagaaaaaaacaaataataaaaagcaataatacaacaataaaaattatacaaataaaaaacacagtataacaaccatttaaatagcacttacattgtattaaggtattatcaataacctagagatttagaatatttggcaaggatgtacataggttacatacaaatttgacaccatagtatatgcaccagaatatattagggacttgaacatgcgcggatacgcgcagattttggtatccgtggggacagagtggggtgtccgggaaccctggaggcttgtgttaaaatgctctttgcggctcgctatattgtaaggcggtgccagctgccgcggcagccgaattacccgagtctcgctcctgcattggccagcggagcccctggctggggtgggagcctcaatgtctcaggctgtaccagacaaacggaactcaaccattaagcaaaacatgggaactcagtttatatgagttacaacgaacacctcagtgactctcttacagaaggcaataacagatggcttagaaattgtggtttcaccttcgaagtctacacagtggatttaatgtgcccaattgggttgggatatgttgaagaacaccatgactacaaagggggtgntttacatcgtttctgtgcagactgcaacatcatagcccttagaagtggcaacaaagaatgtcttacctgttggaaaaaactagttttcccaaagatcaccaagggccagaancccaaactttgatgcactcatcagcacaattttttccaagtcgtgatgagtatgaagctcatcaagagagagtattagtccaggaccaccaagcacaattaatcaagaagcactccagccacagctttgaggaaggactgaagatacaggccatgaacagactgcagcgaggcaagaaacaacagattgcaaaatggtagtggagcagaagataatggtgacagttcacactgcagataatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaacccttgatacagccagtgagaagccagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgttttttttttttccccacaaagtgtgtttccacttggagcaccattttgacccaggaatttttcatagtttctgtattcttataagattcagtgggctggtccttttcctgttcccctcaaaagatttttagtcatacagaatgttaaatattatgtattctgaccttttttttttcccccggagtcttggtatatttatagttttcctatataaactgtagtatcttcatgaagaacccaaggctcaaatttactgtccttaaaaacaattctcataggattattcttttcatggggattttcttccataatatctcattttaaaaagaagttctttatgaaacttagtgtccattgtcatgcaatgttttttttttttccattctttttcccctgtaattttggaatttctggtcctgggaagaatcaaacaaaatcttaagttcctatgagaacttggttcattgacatattctgctgaagaaagaaaaattaaattggtagtaaaatatagtcttcaagtataccgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacaggnccttcctttttttttttttttttttgtaatctgtgccatgaaatttgaaaaccaccaaaaatcaagggaacttttatatattcaattccttttctggtgtaatgttaaagttgtatacggttattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtatnnnnnnnnnnnnnnnnnnnnnnnnntggggtacggggagaggcgatgctattggccatcactaccaaccagggtttcaaaaagtatatacctaagtaatttcttttaatcactatctcaactgaggaagaaaaaggcttcacacaagtggtgtgaaggctttgggtacttagttctaaatttttttatggtaacatatacatagccacatttacagttttaac

SEQ ID NO: 60 - DNA, 770 bp, Homo sapiens
  misc_feature: Incyte ID No: 196709.1
agattggtctcaaactcctggcctctcactcctgccgtcatggcctccaaagtttaatttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagt

SEQ ID NO: 61 - DNA, 6400 bp, Homo sapiens
  misc_feature: Incyte ID No: 037502.4
tcctctgcgtcccgccccgggagtggctgcgaggctaggcgagccgggaaagggggcgccgcccagccccgagccccgcgccccgtgccccgagcccggagccccctgcccgcggcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtacgtgatcacttcagtgagcatccctctatagatgggctttagtaaagactgtcccaaagagcccctacttctctaatgccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaatgttgtagctttatgctttaatcatttcttttaaacccccttttctgtttcctcttgtagtgctgattaaatggccatgtgcctgatatcatcagagttttagcatggatccaaaggcttactgaaaatttaagcagtcagtggcacaaaataaaatctctgattaatgataaata

SEQ ID NO: 62 - DNA, 586 bp, Homo sapiens
  misc_feature: Incyte ID No: 235687.5
  unsure 5, 45, 49, 127, 133, 159: a, t, c, g, or other
tgatnagaatgtgcacaaacccatcagtttaggttgttcacacantgtntgcaagggcctgcttgaataaacttcatcgaaaagcttgtccttttgaccagactgccatcaacacagatattgatgncacttncctgtcaacttcgcactaactccagntagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgtactggcattagaagatggttctgccctctca

SEQ ID NO: 63 - DNA, 1952 bp, Homo sapiens
  misc_feature: Incyte ID No: 085596CB1
aaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaaccgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacgttctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactattgttaaaaaaaaaaaaaaa

SEQ ID NO: 64 - protein, 525 aa, Homo sapiens
  misc_feature: Incyte ID No: 085596CD1
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRTERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRRSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPCPFHCRQIGSVYRLPPLRKGEVLPLPEANFPSFPLPHHKHPLKPDIQPFPQSVSESCPGKFKSGFPQVSMFFTHTFPK

SEQ ID NO: 65 - DNA, 1638 bp, Homo sapiens
  misc_feature: Incyte ID No: 234811.3
  unsure 64: a, t, c, g, or other
tggaggtgatgcgcgggagcacagatccggggcagtgcgctgcgcagaggcgcgcggcgaagcnaggtgaggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacggtaatccccgccccgcctgaccgcagcaggggctaacatgggtggggtggggcaggggcactgaacggagctccccggggcgctgcggggcgtggtgtggggccggcccgcagactcctccgcagagctcgcttctcccgcagcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggtatgccctggtccatatctgcctcttgggggtgggggcctggttgactccttccgagtgactgactgccattggtctccccaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaaaaaaaaaaaaaagg

SEQ ID NO: 66 - DNA, 2653 bp, Homo sapiens
  misc_feature: Incyte ID No: 3393396CB1
acctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatatgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttaaaaaaaaaaaaaaa

SEQ ID NO: 67 - protein, 700 aa, Homo sapiens [sequence omitted]

SEQ ID NO: 68 - DNA, 5982 bp, Homo sapiens
  misc_feature: Incyte ID No: 978439.4
  unsure 1627: a, t, c, g, or other
aagaaattgatctataatgaattcctgatttatttatagaaaagacaattctgctacactctttaggagcataatattcctagtgatagagcatttcatgttaaaatgaattatttttgaccaagtgaggtacatttctattgatacaagtcatgcccctaaaagatagatgttatacagagtagcagtgaattaagaaatgtttcctctaaaagataaatataaaatttccaccatttgataccctaaacagtttaattttaattatagaatgttcatctacaaagtatctagaggaggcttttgctttattccatttctgccaaacttaagagaaaatgtactgatgaagggaaacatatccacattggaaaacatttgactgtctaatttttcagaccttgattcttatatcactcaatctctgtttattgtgccaaagactgagaatcagtgcagtggaaagcctgtttttgacgtcaggacagcatacacttttcaatattggaaaggctatatattctaaagagcaagttattaaagagttatgctgagatatatctttttttggtactaatagaaaataatgcactggtgggtcctttgacagagatgttctagaggaaatgtttaagtggttaaaggattcaaggaaaatacaggaaaaaaggtatgggatttgatgtttacttgttgatctggattaatgtcatttctaaactttagacatatctaatagcctaaaatgacttacaaagaaacgtgtctgtgtgtgtatgtgtatatattgataaatgggtataattaaatatatatacaaacacatacttatatactattacccaggtataaattcttttttcaggattttttagatagcagtagaataaaaataattttaaaatgtcatactttatagtttaattttaagggggaaattggttattttcaattattaaaggttaaaataggccaaatcactttttatgcaatcatgttttatacagtggtctcattgcacattgtgttttttctgcactttttacggtatccttatcatgctggtatgtcaatatacaccctaaagaaaaactccatttaatgattgtgccttgtattctattattttttgcatcattagtaaaattaagttgtctattgtaaatgataactatatgacttaggagaatgtattgctatatgtactgctatggaaaaggaaagcagttatttatttgtttatggtacagttagttattttataccttaaaaaccaacatacttaccatttctattgtttaaaaattactgtccatttttttaaaaatttaaagaatgtagtattttctgaggactggtatggtacaaaaatgtaatcaaaattttcagatactacatttttaaaaagtgaggatggggaaaatatgtatcagcatgaccctgatgtagaaaaataaagtctgcaattgaaccttggcaaaatacattacataattatttctgataaggataagtattagctgtcatttaactgtcgtgaagaatgaaaaagtgatacatttgggctttttagatcatttgtaactaaatttgtacagaaattctcctgtgaaattaagtaaaccantttccagatcttgactgcattgctgagattttgcagttgaaaaataatttcaaatttttcaggttttttgtatatttatttttttctaacaaatatatttaactataaaattaaaattcagtagttaaactcttcataatgcagaaatggatggcttgattgtatagaaaaatgagtctttcagttacaccattcttgaaaataatagtgtatgtttgaaatttgtcattaattagttgcttttgaaggcaatctatttgaaatatgtaatttcctgatgttatctgcattgtgttaagaaaaaaataataggctataaaatcaatttttgtaaaaaaaatgtacagttttaagttgtgtacagaaaaaggaagagcgtacacagtcttagagtggaatatacctctagtacagtgtatgtgttaattccaactcaagcaaagaaatgagtatttaccatctttcctataacatgtaaatgtattattcctgttctacagacactgtatatttatgaccttatttggacattattagacactggtttcttagtaaagcacagtaacttggatcagattctttgtaaccgaaacacttaaacatgtattagtaataccaatatatttagattttatatttttataatttagcttctatgcattacagaagttgaattaagaaatttaagtcatcaccatatttttgttttctttaccacttgggaaaataatcctctttgaggcagtaacactatgtatgtactgttaataggccagaaagaaatattggcagttgtcttaggtaagcaataaaaacatctccaatttactgaaagttcagaaatataactcttacatgcatggaaagtgtaaaccaatttaggtatttctaagtacccaaccctagtattctctccctcaactccaacattctcaagtcccagatgaaaagtttcagtggagcattagtttaaatatttagtctaatcagagactcacagccctgggcaatagatacatagctttttaaaattttatcctttgtgacctgctatagtggcattggactattttctgcatgtattataaactaaagattggccttatttcaattgtttttattgcacaacttcactacaaatttaaagactgctggcattattataaaactgtcttcctccaatccaagtaaataagtatgtggaatatttgtgagctggattaggtaacatctgagacttgggattgactaaatttagttatcacttggaaatgaattacataagatacagtaatcagagaaaatatctttatgcagcatgtatgttaacatctagaactgtccctcatctgcagtgcagtagaggaatcagacattttaagaaatgtattcaaatatttttatcttatatgttagcagcatttacatgttttcagatatgatttgtaatataaattaatttctccagttaacaatgtttacttcaattctgacattccattttatacatatatacctactgtatatctctctcaaatgtcagctagaagcaactttttcagttttctatctaatgaaaacggatatattctgaatgtttttgttacctgaaatttatttttgagtaggttgaaaggaccaagatacttgagtgattaaaggactgtaagtgttctgcttatatgcaggagttacatgattttaaaagtcataataggggaagtagttttatcatctgattactcctattaacctaaaaagtatttctaacataacagattgagcagtggttttgttacacttaggcaagaatttattttcccattaaaatttgaaaaatacacttttctttgcttctacccttgcagtttcccttagttcccctaatttccaagtgatctgaactaaaattaatattacacttactaagaaactatttttgttaattatactgagcaaagtttgctccaaatgaaaagtcattacgaactatgtatagtacccaagaaaaggtcaaattgagtcagaagactgtaagtaccacttttggcgctccagagataaaccttgtacacactgcagtagaacagtgagtagaaaatatgagctataaatagatattatttttagttttgatagctctgtgttgaaatacttttttaatgcagataaaaattatcaggaaattaaccttatggcacagaccaaatacttagtgcatggctgagtttctacaattcaaggagccaagaaaataggttcaagatggaatatagtacatgcatataaggcagatgcacacatgctggttactttaagattgtgtgtgttgattagtcacaatgatagactataacatgagacaatataaagttacatttttggaccatattaaaactgcaagaagacaggggtcttactgaagatcttttagaaaacttaaatcctgtcacaggatatttagacatgtgtagaatgtagctcaatttttaaaaagtaactgacctagagggtgaaagttgaaactgacacattttcaaattaagattatgcttattttgtacagaaaacaatgtttaaacacaagcagatctgttgtatgtaataagtaacacagagttttaaaacaaattaattatttagctttattgaagtttgtttttttccttccgaacctggagtatcatattataaacagcagtttcacaccagaatagcagtgccctttctttttgtacatactgattggacctttctttactgttacgtggacactttctatgttagttttgatgcataattctttgaatccttttatacaaactagaatgtatgtgtaagaatacctgtccctgcaatgtagtaactacaaacttatttttaaataaatagaaaacttgtttttctaagctattttgtagagcctcatgatttattatttgctttttaaagttttttggcatcacataaagcacttagtacataatctcaacaagctgcttaccaaagtggtcatatggcagataccattatgtaaatgctggttcattagagtttccagtgccctgtgtgttttgcaaagtgtgaaaactgtcagttaaaagatatttgggtgccgaaatgtaatttaattccaaaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgcaatttctgggaaaaaaggaatgatggaaagaaggttattgcagttttcctagaaattttgtcagattggcatgcatttttattgactaagaatcccaattttagcatgaagaccattagatatgaatacataaggccataacatttcaaattaagcacatggagtgatttgtaattttgtgttaatttctccctaagatgttttgttaaaatgattttgtatataataaatttctaagttgaggaaggaaggtaaaaaaaattcctgataaccttttctttatgaagtctgctaataacaatacctagtatatacttagaagaaccagccaagaaaaattacctttcagcaaccactctttacttatttctcttttgtaataataccaattttatgacccaggattccccagtatttaacggaagtaagattaaagaccaaagcacaaaacctctgttccttgcaatatagtacttcgtgtttgtaatcaatgtgtggtaaatttaacacatttaccacttactgattagtctttgggaaaagaatggtggaagtcattcaatgaaatacctttctacctaattggttagacatactggcagcacagtgtaatgaactggcctggagttgggaaatgggaatttgaccttcattcctgacaggaagtagaggaaccccagcaaagtcgtatctcagagcttcattttcctcatctgtaaagttttaaaggttgattaaattatctgtgaggtctaattctgttcaaatagccagtggtgataatctcatttgtatactgtcctctgtattcatggctcaactttggcttttatatttagtccctaaatagaatacatcatttaatgtgtagcttccagacaagctgtgtcttgcggccatgacctgattgttgttaagtgtgaggttttctgaacccttagcagaaggacttttaatgtttttacaacacactattgtattgctataaattgtgaattgctttaaaagtacatgtttactaataaaaagaagtacaggcac

SEQ ID NO: 69 - DNA, 242 bp, Homo sapiens
  misc_feature: Incyte ID No: 011390.1
gaaaagtgtgtgttaacattaactggaataattcatacaaagcatttaacttagtgcctggtgtggcaaggactcagtaaaccatagctacaggagggcagactctctaaccacagaacgtgtttgcctccttcactgttagacccatagtgcctactataaaagagatgcttaaaaggtgtgtgttgattgaatgaatgagcatcagtattattgtatccatttaaaaaggaatctggggt

SEQ ID NO: 70 - DNA, 536 bp, Homo sapiens
  misc_feature: Incyte ID No: 1382924.42
ttttttaactaaactaaatggtcaatactgccatctctcttgataatgacaaagtgtttgcacaggatgcctacaggtgtgtgtgtcgctcctcactaatggatccgtagtcatatagctgtgagaggcactcctgggttgaaaatgaaggcaattatcacattactgtcagtcctgactgagcggcacgagcggcacgaggattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcggacaggctgcattggggccaaacacagaatcagcaaagaggaggccatgcgctggttccagcagaagtatgatgggatcatccttcctggcaaata

SEQ ID NO: 71 - DNA, 2471 bp, Homo sapiens
  misc_feature: Incyte ID No: 1256895CB1
ccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaaaaaaaaaa

SEQ ID NO: 72 - protein, 253 aa, Homo sapiens
  misc_feature: Incyte ID No: 1256895CD1
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 73 - DNA, 530 bp, Homo sapiens
  misc_feature: Incyte ID No: 011115.1
  unsure 14: a, t, c, g, or other
cctctttctctctntctctcatggctgaaactggtaccttccagcagagacaccaggaagttggaggcaaatgagaaaatatccattttcactgtctcacagatttcagttcagtaacatctgccagtcatatattcttatcacagggatatttcatttttgctgtgcaatcatctgactcaagagactgggtagatggaaggtaaaaccaaagatgcttacttgaggatggctgcaaatggcaggtgacttctcctggcatctggcgaccacatccaccgattcaggctgcatggtgaacaagatacaatttctcttacagtcagagctgctgagggctaagtgcttagagctcctcagcaaccctgtgaagtcagatcaataatgacctgatctggtactcagggaggccaagtcacacacccagaactgacgaacggcaagcgctagaatccctccaggttgcctgagttcggagtctgagatcttagttgctgcaatacactctctccaagcccatgtctcaagaa

SEQ ID NO: 74 - DNA, 3598 bp, Homo sapiens
  misc_feature: Incyte ID No: 291267.1
caggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccataacaggtcgtactggccaatgattacttttacttacctatctgtactaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctaagaactggtccagccgacggaagagtaggaaaagagaagggctgctcagggaaacattgggctggggggcaccggaataaagcacatagtaaaaagggaacatcaggggtcaaatggaaatcacctgagacaggaaacagggagttcatttgggccacactggaagaaaggcaagaaagaggaagacaagtcttggagtaccctggctgttctccacactcacaagacatcagctatatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagagtaactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctgggatccttgcaagcttaggataaatgtgatctttattagatagcagtggcatgcttttaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaaattattgcacatattaaataacattcctctatgtatctcaatggcattaggacattaggaggaagcattttgtggagggatttgaagttgagatcttcatccaagaagtagcttttcaatttgctagaagcttaatgtaggcaagccactttcatttttccagaacttgtttacttcatttataatatgggaataaaaatttgtgcaagtcagagaagggtgccttaaaaatgttgtggccaagccacatggaggatcaaagacacacttttcatgacctcaaatgtgggcccagcctaggtcagccaacccccatccaacccttagactcacgaacaaatccacctgagatcagcagagccaccctagatcagctgaaactttaagcacaaaaataaaaacttatcactgtataccacctggagttttctggttatctctcgtatagccaaatctaactgatgcaatctccatctggccttcatccttctccctttattgtcctttcgtgtattgttcatccagcaaccacggatgatcttgttaaaacattaaacagattctgtcactcttcttcagctccctgtgatggttttccaatgtgcttctggaaagagcaaacatccttaaaaggc

SEQ ID NO: 75 - DNA, 5837 bp, Homo sapiens
  misc_feature: Incyte ID No: 3125723CB1
atatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggcttgttagcacactcaggggtttgggagtccgccatccggagttgggcacacgccatttctgttacggtgccgggacccaatattgggaggctaaaatcttcttgagccgcgcccccttcttgtactggggatagtacgcccctttgtgtgtccggggcccaaattctttactttgggaaagatcaccatttcccgggaggccccaaaggggttttttgccgtatttcccaattcacaactgcgggaatttttccccc

SEQ ID NO: 76 - protein, 1739 aa, Homo sapiens
  misc_feature: Incyte ID No: 3125723CD1
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 77 - DNA, 3080 bp, Homo sapiens
  misc_feature: Incyte ID No: 980593.1
caaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaa

SEQ ID NO: 78 - DNA, 1148 bp, Homo sapiens
  misc_feature: Incyte ID No: 980593.6
agttagtgaaaatggttaattcttctcatggtgttataaaccttattcaacctgactgtaatccatctgtgttgctaaaaaaatttcaactcagctaactcattttgaatgtaaaatattattatgattttgcacatcaatgtactcagcatttattcagttggatgactacattgtatgttaggcatttggtaaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagcttt

SEQ ID NO: 79 - DNA, 531 bp, Homo sapiens
  misc_feature: Incyte ID No: 410739.1
  unsure 25, 211, 523: a, t, c, g, or other
ggccaatgcaaaccagctgcaaaanctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagagggactccagcctggggcacggagattgnagagcagaggcagaaacttgccagtctgaacagtggcagcagagagcagtcagggctccaggctagcctggaggctgagcaggaagccctggagaaggaccaggagaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagacttgaatttgagaggcaacagcgtgaagaacttgaaaaattagaaagtaaaaggnaactcata

SEQ ID NO: 80 - DNA, 2029 bp, Homo sapiens
  misc_feature: Incyte ID No: 405773.2
  unsure 1227, 1248: a, t, c, g, or other
ggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacgtgtggggagtgtccccacccaatgctttggaaaatgcaagatctaaattattgtaacctttatttctgtatgactgctggacagtgtatgttaggtcgtttatgcaattaatgagctgcataggttttccccactccttaattggatgcttatattttacttgtttcatcattagtgaccaatgtctgagtttgttgaaaatgttatttagtgatataaaagtaaatttacagcatcctaatgaagtgtggccctcaaatccacagtagtatattttcttcttacttcgctccgaagactgactagggtaagcagacagtatttctctgggaggaattattcttctgttaacgtggcctggtaacagccaagttcttgaaggtaacagggcaagtctgtgctgattttgcttctattgcctttcgtatttaggtcaagttaagagacttattttcagggtttcaagcagccaattaaaaataccttttaaaaaatagaaggaaatagaagaatggattaagaatgtaaatagaaaatttatgtaaacatagagaataaacgtagaacaatgcttaagcctacttataattaataatgaaatactaattgataattcttataataaaaattaaagctaaaagtaaatgatagcatgctctcagtaaaactgatccactcacaaattgctggagcaatgtaaatcaacccaacctttttgtaaaatgattaaatacagaaagagccataaaaatattcacacccttgggatctttgttttctctacatcaaggaaacaatttaaaagactgaaaacagtctatataaaattgcatttaatancagaaaaaaatggaaaaatcntaaatattcaatagtcaggctatggttaaggaaattaagagatatttggcaaccataaaaaacaattttgaagattccataatatgaaatggtagacccagactgttaagtgaaagatttagtttacaaaatattgagcacactgtgattataacagcaaatatatttgcatgtggacaaagattggatggcaagatagaaaaataagaacagatgtgatagcaagaattatagttggcttgaaaaaatgtgatgatcaggagaaaaaataaaaaaagggtagaaatattagacggtgcgtagggactttctatggacttttattaattaggaaacattatcaaaggaacttttcacgtatttttctttaaattctggttagatgttattaataattcttcatctaacctactgactagaaaatatagtcagtactaaattagaattgtggtttataaacttttggttagctctggatctgtataactgcatttttttggataaacagtttttggtaggtggataccgggagacaagtgtgggtccctctcactgggcttcattctgtggaccaggatcattatttcatgctcatgatcatgagagttaggactgagtggctcctgtgactcccaccatcttagatgatactgttttcttgtgagttctttcttttggtgtggattagtatatcagttgatttgtgtgaattgtggtgaaacaatcatttcattttgaaaagcaagtaatgaaaatgtcaacatcataggaattaataaaa

SEQ ID NO: 81 - DNA, 468 bp, Homo sapiens
  misc_feature: Incyte ID No: 210871.1
cgcagaggtccggagctttcccgtcagcaatgagtcaagaccggaagtctgggaaagggtgctctcagttcccgacagcgggggctggacaagacggagacggtactggcaatacgtcggttgaagggaagcggagcggagcacgcgcgggctgtgacgagggagcggagaaacagctgtcccgttagcctcgtgttgacgtcccgggttcagccccaggaggacgaaaagactgtgccgtgtccttcccgaggggagtggcgttcccattgacctgcatacctcacctcatactcgtgcgtggacgtgttccagccaagtcccgttcactccagctcctccgtctccaccctaatcctaattattggtgtttcgtttgaaagggttctgtgaatttgtcaagcaggaaaatttggggtccgacagaattaagcaattctctttaattaaatagcttgcggagtcttt

SEQ ID NO: 82 - DNA, 172 bp, Homo sapiens
  misc_feature: Incyte ID No: 020265.2
cccacgcgtccgtccgtgtgtattagattgaacaagatgaatcatccccactgacagccatcatggacccttctttttcccttcgcagttagtcctagcctttccttggttttctttatacttgtcccaaatatgaattagccttaaacaataaattatttacttttgcaac

SEQ ID NO: 83 - DNA, 1362 bp, Homo sapiens
  misc_feature: Incyte ID No: 039840.1
gaaacatgaagtttcaaaatgccaagatgtatcacagaagacactcagcagtcagccacatttatcttggagaagagttccaggacttaaatgtttgaatagtataaactagttttttaaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaaattgtcctttaatattcaaatgcatgaaccatcactccttggccttttggccaaggatcaagtgtagtatcaaatgcatgaaccatgaaagctatcttaaaaggaaagtaacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaactacatgtttactgaaaatagtctttttttctttgctttccagttttacacttttgttgaacacaaaaaagtggacaagatcaaataactagatggtaaaacactgattttttaaaaatcacatctttaaacccgtgagaatcacaattcaaagtatggccactgggggcaacctgtaaacctacaaccttttcttaacactgacactatgtgactgatttttcttaaaacacaaatgccattaagaaagtattttttgttgacacattctgc

SEQ ID NO: 84 - DNA, 824 bp, Homo sapiens
  misc_feature: Incyte ID No: 088564CB1
gcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaaactatttaacattcttttgtttatattgttttgtctcctaaattgttgtaattgcattataaaataagaaaaatattaataagacaaatattgaaaataaagaaacaaaaagtt

SEQ ID NO: 85 - protein, 96 aa, Homo sapiens
  misc_feature: Incyte ID No: 088564CD1
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 86 - DNA, 429 bp, Homo sapiens
  misc_feature: Incyte ID No: 028889.1
ctggaagccatgcctccttgctttcatctggcttacactatcttttcctccaaacatgagttaatgggtggtcttgagttggaagagtggactgaagaaagaacttatactctccctcctctaaaattgaactaatttattttttaaaatgctaaaccaaaagcagctaaaaattctccagttacttatctagggtatctccaaacccagataaatgacaatgttagaaacttcagcaagtggtcatgaggaaatgagtggataattccagtggagtactgggaggacattgattctcaatatctaccacccaaacttcattttcatcactgtaaagaaggtgaattgtgactactgttttggttatgacaggttagataattttgatcaagccttgtgttgaaaataataaaatcttttggggaaaaa

SEQ ID NO: 87 - DNA, 472 bp, Homo sapiens
  misc_feature: Incyte ID No: 410611.1
gtagtgactgacgaaaacttgaggatgagtaggagactgtgtaacgagaagaagcaacaaaagaattttaaataccaatgacctttatttttccacaaatattagaactattctgtcagacactgtgccaagataaaaatactttcctttggtgacagagcataaaattgaatctagttggagacatttgttgaagaggcctgtacatctttttctagagcaagagtaagtaaacttttctgtaaagggccagatagtaaatattttaggctttgcaagccgtatgtggtcaaggtcacattttttttaacaacattttttaaatgtaaaaaccattcttacctcccaagccttacaagaacatcctgcaggccatagtttgcagacatctgtgtagaaagaacattactgtgtttacaacacaatatagcaattgattttactggtgatgactcttttcaagaaaaggtta

SEQ ID NO: 88 - DNA, 1393 bp, Homo sapiens
  misc_feature: Incyte ID No: 212533.1
  unsure 861: a, t, c, g, or other
ggacaagggagtttttctttctttagcgtcttcagtgaaggatacaatacaacaatgcctaatgtatttgactttttagcttgtgtctgtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtgggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatatttnagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggac

SEQ ID NO: 89 - DNA, 2590 bp, Homo sapiens
  misc_feature: Incyte ID No: 024081.12
  unsure 1099: a, t, c, g, or other
ctcccagattgaacaagggaaggagcactgcaactggcgccgcctggccccaagattccagatgttcctgatggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctggtgtccattccaacttttccaccaccatcccgcccacctcctgggcaaacggatctccctccccaccatccctcttcagcatgctcggacgggaccctgaagctcaacacagcagcctccacggaagcagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcaagctgcncttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtaactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtgggtgaacagagatttccaggttttccctcttaaaatatttgtcccac

SEQ ID NO: 90 - DNA, 894 bp, Homo sapiens
  misc_feature: Incyte ID No: 983961.1
acattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctcccctttaaaa

SEQ ID NO: 91 - DNA, 2260 bp, Homo sapiens
  misc_feature: Incyte ID No: 1383290.2
attttatgaattcagaagtcagtttttaattgcagaaaactaattattttctttttaacttacagagggtggttttcctgaagcagctggctagtggcttattacttgtgactggtaagaaaatccttggattgtgatgttctgtgaaacttccatttttaaatgcttgcagtatacacgtttgtttgctactgcctacatggtagacacttattgccacaagtgtctgaggcccatttcattgccttgtgtgcaagtgggttagacaagtggtcttctttgtgtagcaacataacaagtaatggtcacctaaattgcaggatgatgattcttcccccttttccttgctaaattaatttttcccccttaggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccagggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctcttttctgtgtcgaagatctcaccttcctggtgtctgggcttccgcagcttcttcttcttgaagtaagcatcagtaagatgttttgggatttttacattgctgatatcgattttggttgaagtggcaatgacaaatttctggtgtgttcttcgtagaggaactcgattggaggaccagaggtccagtcacaagtaataagccactagcccagctgcaaccttggatttagtggcttattacttcctcttgtacatggcagatcgggaatacatggcagatcgggaatacctgccacttcctctgacaaggacagggttgcggctgcaatggggcttccccttcttgggctttttagctttgagattaccctttttcaccttgccaccagcatcaaccttcttggcttcgggtttcttctctttagtatctggcttctcaactttttcacccgccatctaaaaatatttttttgtagataaaaaaaggcattttaccagtcatctctctaacaagacaataatgaacctgtacatgaatgggctgggctccccagactacaatccctcccccggtaagatacaggccttcctctcaaactctacccattctactccaaccttcactatgactcatttggggtttgtctccccaatacactataaactttttttttgagaatttgaaactacctcacacctattaggttttttgccaaatactgagcggtcagaagtccgtacaaccattattttttattactgttttgcgaattagaaaacttagatgcagaatgtgtccacaggttagaagcaccaagaccagaacttgaaatcccttactttcagtacctttcgtcttaacccttaagaccagtgtctcttttcaagaaactcgatttaggaattgcggacacaaacggaatcagcccaaattgagccagagaaaaagatcgcaaagaccaagaggcgacttccggtcggggacgctgggagacgcgaaaccttttggcttcagtgcggaaccccaacgtggctgcgacaggctcagtgtcatcctctggaacccaggaccaggaacacagtgcacgcgccgtctccccgcttcctctaacacccaccagtctgctacgggtccccgaaagggcctcgttcccccagcccaagagagtggcgaagaaccggagggagccactacggcattctacctcaccctctttgtgccctgccgcaaacccaaacaacaaaaatgaagcgtctggaaggcctctcagttagccttggacatgtccgacccctgtaggtgtcgactggatgccctccaggttcggatggcgaaggattgggagtcctgaactcaaagtcttgcagacaggcccgcgattcttaccttg

SEQ ID NO: 92 - DNA, 2375 bp, Homo sapiens
  misc_feature: Incyte ID No: 337221.11
cccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgcccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgccctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctgagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctgtacaagaaaaaaa

SEQ ID NO: 93 - DNA, 3915 bp, Homo sapiens
  misc_feature: Incyte ID No: 290344.1
gggagagacagagggagagtgtgcatacagcagctgtcggcatccctgtctcagggacttctttgctgattcacagaggcagcccagccccggcctcccagcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaaaaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaggggcatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttgatgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcacatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgcggctcg

SEQ ID NO: 94 - DNA, 1253 bp, Homo sapiens
  misc_feature: Incyte ID No: 290344.3
gcgagttgctctggaaacctggctgaagccaccctttgctcctctgagtctgtcctcacagacctgaggacacagtggcagcttgctgagcaagggagtgttgctttccttgggtgaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccaccctagactaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatatctcttgaagtattaatgttctgccttgctctttgttagccccagcctctggttggaaagatagatgtatcctggctgctcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttggctcctccaccactaagtcacaggtccagg

SEQ ID NO: 95 - DNA, 340 bp, Homo sapiens
  misc_feature: Incyte ID No: 222714.1
aaaaatgataataattaaaaaaatgcagctctgtgggatgccaaaaagtgaaaattgtaataatgattatagcaatgataagttgttaaggaataaacaatatataaagatgtatattaaagcaacaaaattataaatttgggtgcagaatgaaagtctagagtattggtatgcaatgaaagttaacttgttatcagcttaaaatagtctattataagtatgagagatttttaatgtaaccccaatactaatcacaaagaaaaaattacaacagatatacaaatgagaaagagaaaggaatcaaagcttaacacaacaaataccctaatcaagccacaga

SEQ ID NO: 96 - DNA, 424 bp, Homo sapiens
  misc_feature: Incyte ID No: 002230.1
agctctaatacctcaaggcattgcatgtaaagcatagacgacaagtgagaatctaggtaacttattacttagaaattgatttgagaccatgtgaaaataaatgtctcagacagttattaagagcagacaacttgatccctatgatcagaaatgaataatataccaactccaaatagactcatcatacaagccaaattttcggaaccaggatcttgtgttggatattaacaaagtgaagttactgcaggatgtacggaagcttttggtaagctatgatcatcgtttggattacttgtgctcaaaacacatgatcatggaaggagggaggacagtttactttggaatgaataccactgtaagtgatgaggattctcttccctgacaggtgtttgactgtttttttcaaaatataatgccagttctg

SEQ ID NO: 97 - DNA, 944 bp, Homo sapiens
  misc_feature: Incyte ID No: 034424.1
ctgctgtctctgaacggaataaatctctgatagtatactaagagcagccttttattgaaagcctatatatgccaggctgtgggctaggcactgtgtatactttctgattttcactacagctttgcaaattgtttctgttaccatgtgatctatttgaagcctgaagatcagataaattaagcagtttgcccaaggacataggtaaagttaaatggtagagatgggattccctggactttgaattctctttttgtttccttattttatttttgagaggggttgggtatgttgtggcttgatggcaggatcttttgtaatgaaggctagatggaacatttaaaggggaatgtttgaatctgaattatagtagcatagaaggtagagttctttttgctgaaaaataaaaacagaaaaagcattagccttcatcatcaagaatgatcttggataaaacaggttagcatgctggttatttctctgtgtattactattcctcttgaaagagaacaatggaattaataggcatcaggagacttaatgttattattttgaaaagcctaatagaaatcatagggcacattaagatacaggaacaaaaaagaaatcataaatttactccctgacagagctatacaggttaactgaaatatcacctttcttggcttttggaatgtggtcatcctggctatcttttgttaatcggaaggtcagatggatggttttctgtgttttggattagtagaaaattagaaagcaaataatatattcaacaccttggcagacaaaattgttaaaaattgtgtagctaaaaaaaagcacgttttttggtggtgagactggtgggtatccatggctctgcccccaggagctcctagacaagcaggcacagtgtttccagtagatgagtacattcttaagaaagcagatatctttttttgccatcc

SEQ ID NO: 98 - DNA, 785 bp, Homo sapiens
  misc_feature: Incyte ID No: 153237.1
  unsure 325: a, t, c, g, or other
ctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagantgagagtgctagaaggaattgaattttagtaagattttgaatctaggaccaagagaatttgctgtaggcttggatttgggatgagacagaaaggagttaaggattctccagttgttctaacctgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggacacgtggtgagcactggggcatattctcctttagtggtgaggggc

SEQ ID NO: 99 - DNA, 6732 bp, Homo sapiens
  misc_feature: Incyte ID No: 272843.14
  unsure 444, 4904, 4907, 4910, 4914: a, t, c, g, or other
ctatctgggaggcgggtcctccccgaaatgccccgcctccgcctcgaccgcccagcatgagctgcggccgggggaacccagtttccgaggaactgtttcaccggcagccgggccgcctctgaggccagggcaaggacacgaacgcgcggagcggcaggcggcgactgagagccggggccgcaggcggcgctccctaggaagggccgtacgaggcggcgggcccggcgggcctcccggaggaggcggctgcagccatggacgagccacccttcagcgaggcggctttggagcaggcgctgggcgagccgtgcgatctggacagcggcgctgctgaccagacatcgaagacatgcttcagcttatcaacaaccaagacagtgacttccctggcctatttgacccaccctatgctgggagtggggcagggggcacagaccctgccanccccgataccagctccccaggcagcttgtctccacctgcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagaccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtggacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtggcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgccccggaccccagcccctcccttcattcccattccccaacctaaagcctggcccggctcccagctgaatctggtcggaatccacgggctgcagattttccaaaacaatcgttgtatctttattgactnttnttntttntttttctgaatgcaatgactgttttttactcttaaggaaaataaacatcttttagaaacagctcgatacacacaatcttcagtgtgaagcaatatactaataagaacactagtcgtcttaacatttacagtcttcatatatattatatatatgtatatgtatacatatatatacactatataacgaggccagatataatacacacgtttaccattttacagtcatatgtacaggaagttgctagggcggccctgggctgggggctgcgtcaggcctatcgaagcgtggacagagctgaggacacggacggacaggcggacggactggcagggactggcccgggccggtggtggctgcgtggacaagtggcgtcgcggtagccccttacccggcaaaggcccggttggggctctgttgcgggcgcacgacgcacggcggcgacacacgggagaagcgagcatgttcccaacatatatacattctatgtaacatatatatagaggggtacacaggttttgtacacgaaatctagcgctgtccctgctcccgtgcagagtaggcgcggcggtccctggtggtgcacaacggtcgcgcgtccgccggagccggaggtgcgttctggccgcttcttgggttttgcgctcccaggctgggctccaggggtggggtggaggactggaaaggggacaaacagaggccaaagggtgtcccagtcccgcccacactcggggatcccgcaacccctaactgagcatagcccaggtctaccccggctttgcccgaaccgcacgagagatctggcaaaggctgggcgggaaggcccctggacgcgttccgcacggtttgttccaaaggctccggcctctccagtgccggcctagcccgctctcagaaaggcttcctttctcccccgcctagtccacggagctaggagccgccctccgcctcttccagtactgtttcgacccccacccccaagcccagggctcccagctgcacgccacgaccgactggggtggcggcagcacccacgtggaatgtgtgccacgtcgtcttgagattccagagggaaagtgtccccaggacaaagccgtctcccaccctcgccggaggctgagcgccccggggagtctggccgctccgcgggctccccctccgcaagcctggcccctggggtgggcaagaacgccctgtgccgtccggttccgggagcaggcggctccggaacgggttttcctcccaacccggggccgcaagtctgagccctaggcggccggatccacgatccgggacccggatcaaggatcggctctggaccagcgctgggagcagctcaaaggcccgggggctgcgcaggcggctcctctccttcggcggcgggcgggcaggcgggctccggcggctcctccggccgttggggtggattactacggcagcctcttatgtttgggacatttcaaagaaaagttctcttcgatgaatatgcaacctgcatcgctggcacacgggtagtggtaggtgtggaggcatcctttgtggcagcacccgatggtggccccggcttcttggcagctggaacacatcatgtccacggccaccttcatggcctcctgcagcccaaagagcttcccggccaccaggtagacgccgccggtccacacggcacaggcctcatgcacccagtgctcctgggcctccccgccgggctctgccggagcctccttgctgcactcatgtttgcgacccttgtcggctggggctgcctcctcgcccccatcctcccggccatcacagcagtagcagctctgcagcctccgg

SEQ ID NO: 100 - DNA, 6510 bp, Homo sapiens
  misc_feature: Incyte ID No: 234729.3
gccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaggtcaccaaagtaaagaacagccggcggatgctgtcaaataagccacaggacttccagatccgcgtccgagtgattgagggccgacagttaagtgcgtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagacacagagttaggctttgttccaacgtttggaccttgttacctgaatctttatggaagcccaagagatacacgggattcccagacccatatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggctggttgataaattaatgccagctgactgaagagccaccagaaccagcatgcctgacatcatcatctggatgatccgggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaataacat

SEQ ID NO: 101 - DNA, 758 bp, Homo sapiens
  misc_feature: Incyte ID No: 349647.1
  unsure 185, 198, 211, 225: a, t, c, g, or other
acatttccccctttttttctttaacatcttttggagaaagcattttaaaaggaaatatgtgttcctggcctcagttcgctttttcctccttttttgagctggtttcttgtcgctaggatggtttattcccaggaaattcaggtctcacgttactaggaaggctcattcctaggagggcaatgttnccaatgttgctangggagagggcttnaattcccttagganagttcatgtcccccaacaaaagattaaaaaataaattgggggaggaaagagggaaaaaggaaggaaaggagatgattctgagggctccagactttaaagagagaaaagggtcctatctcttttctcttaatgttaaatgttactttgtttgttgtagaatgtttagcctataaaattcatatattgattaagtatactatgatgtatggtgtgcaatactgactggcttgtggggtgacttgagcctgtgtgctcaggactatgtgcccgtgactccctagtgcatgggaagtactaaggagaattgctttcttggaaactccatgtagttcggtggcttttgtgattgcacacagcaacagtaaaagtctgaccctgtggaaagacacaaatgtgcgtggacccggctatgtctgactttgtgctgctcaggacactctctgtaaccaaaagtgagagagcctggaagacctcagggggtcagatgtttgaaggagctgctgagtatcctggcaggcagcagagcctcacca

SEQ ID NO: 102 - DNA, 1200 bp, Homo sapiens
  misc_feature: Incyte ID No: 236457.1
ggcagagggtgccttaactttttctggcttgacccctacttccttatgtgtttccttcatatacctctgtcactttagagatgtaatcatgtctgttccaagttgtatcgttattatcaagaagtcctataaatgtagcaaatgtgactattttatagaaatgcacaatagtttataggccttggagaagtctgataatagtatgtaaatatccttcattgaagtcatagaaccttctagtaggaagctccataggtgataactgcaagaggattaatgtttgtttctccagtaaacaccggaagcaaggaatcaatctgtcactgtttatcattcagtcttgagcaccgttgggtgttgataggttactatagacactccccttataattaatatacaggactcacaatttaggatgtctgatggccactagggtacatcatagagacactagagagaagagaacaaatatagctccatcaaaaagcctgcttaatctttaacaagtctgaaatattactaaaattccagttaccgtgcagcatagtcagtctaaaaagcactggggaaaaaggtgtctttttggtctctttaattctattatggcacattttaatattattccacatgtgtgcaaactatttctcaagagcaaagtttgaggctggagttaagaaaatagaaaaattaaaacattattttttctcatataatctgactactagttcatggatataataattctgggagaaaaattaaaacattattttttctcatataatataatctgactactagttcatggatataataattctgggaaaaattttagattaaactataaaattgaaatcacctttgaagagtatatggaattgcttctttctattaaagccaacctacattggcaaaaagtgtggagaaaatcagtgtgctcaattctttttgtagagtttcatctaaaatgttgcaggtaaaaaagaaaactttaattggtactttctacggtgtgattagaaaaattagtatctatctctgttggttctgctgacttgcttctttccaccgaatctaaatgcaatgtcataggaggaggtttgctgtaaaaacatgtctttttctttggtgtattcattgtaattatggctggcagtgagaaggttcggtaagtctcaatttctctacctcctttactcggag

SEQ ID NO: 103 - DNA, 3199 bp, Homo sapiens
  misc_feature: Incyte ID No: 230193.1
  unsure 3194: a, t, c, g, or other
aacttcaaatactattattttaaatttatgttcattatgtaattcagggagtaacgatgcctggagcaatttctgaaatattctcaaaccacttcactcttgacactacagatttttctctcagtctcaatcagaatctctgcagtcattatttgtttttaagatgtgagggacgaggaaaattactgaagaaattctagcagatttcgattgcagagaaatttggtaacactttttgggtaactgggtaaattactatttcttttaataatcgggtgaaactctgaattgttaaaacggaccaataatcaaatggttttataatctttcttaacttcccgtccttgttataacatcttggaagaagactcttcaggataaaaaggatattatttgattaaaaattatagcatttggagaggtaacacacaaaaacaaaaacatatttgacaaagcgccctacatcctgtgttttgttaggactagaaactatactggatgagtatgtatactgcatgtttacacatgctgtgtttctttatatgtgaggcttcactgaccaccgtgcattttgaaattgtattgcattttgtgtgtgtgtgtggtgacaggtttgctcttctcacttaaggagctctggtctgtgtaggcagtacagtgttgttagggaggttgctgaattatctaaaaatgtatccatgaatttgggggaaataatgcttaatatctgaagtattttcagtaaatgtggagatatatcagataatacttttaaattagtggaaacacatttctgagtgaactgagctatgaactataatcatctcttcccctgagtttagggaagttgttttcacattctttacatttattgcacatatactgaacttacataataactcttccctgattttgagaacgaatttagcaatttcctaaaaatcttcctcctctttccatacagatgtcgtatgttatagtttaaacatatgtacaatttgttgatagaatccaaggagctggtttaggaaagaatactcttaacccctacagttatgcagctctaatcttactgaaaagtaaatactttaggcaagtcaggagagcatgaacctcatacatacatttttacgattatgtactgcacccacatgtatctactcttggtagtaacatgactccaccctttttgggaatgtatttaggtggataactgaaacggaaaagcagtttgacacaaatacacagaaagaggaattgcggtgcataatcaatcgtctgagtcccataactgtaacactttttctcttataaattggtagttcctaaaaatcaccactttaaaaattttattctgtcttgctgaattaagcagaaatcactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagtttaactgttgacactttcttaatgtttttgatgttggatgcatttacaatggaagaatttttttgaaagatttggccctctcaccaatacacacattcagacttgagctgcacgcatttagatgaacaaataggaaattcacggtattttttgttttagccatccaaaattcataggattctaccaaaaatattagcccctgactctagttattctgagatgagggaatcaactttatcttgaaagttaactagctaaaatgtctttatttaaatagcaaaaatatagtttacctgacaagtattaaaagtctcactttcaaattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcacctgtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggattattttaaaaactatgtttatatataatacctaacaagctgtaaatattgtatattattgatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttganagctt

SEQ ID NO: 104 - DNA, 930 bp, Homo sapiens
  misc_feature: Incyte ID No: 213429.1
ggttttctaaagccattactgttagatacttcatgttcaaatatatgttgattacattatgctatgcagttaacctcaattcattgattactgttctattgggaaattgtctgaaaaagaattctacttggtttcaatgtaatgtgtcacagtgaaaaaaacagtcagaatatcaggacatagaatctcatgaagtttatcctgcctgaccatagataaaagaatgcatgtctgctattatatcctgctcagtctagaagttagtggcttagacacttccagaagtggagctccaactgcctaaaatagcaagatacttccttattggtgagctctgatgatagggttggtgatagctcaaagcccatgggcatcagtcagtggaattactacaaactccagacttacagatattgttgagtaacttgtttattctatattgggttttccttagaagcataataaatcacgatacactgatcttacattcactttttgatatgtgtgaaaatagactacccaatgatggtttttatatgatttaaaaccaatcattcagaattgagaggaatagttacttaaaacaaaaaccatctccaagcaattcaacttaagaaaaaaatcaacattcaagagaacattattttttgtctcataaataaatacctcataaatagatacctcattgtataaagagaaaaaattttgtcataaacaactgctaagtctatgcaagtaaatctcaaaaatatactatctgtgcatcaactacatagctgttaacaaaacagaagtaatatcaactagttattgaaaagctagattcagagcccttctgaaaaatgaaatcctgggttaatgactcatatgagaagcaattcttcaaaaagaagccttggcaagcttcaggatttgaaaataacttttctt

SEQ ID NO: 105 - DNA, 740 bp, Homo sapiens
  misc_feature: Incyte ID No: 005124.22
ttccggctgatatcttaaaagaacttttcaactttagtaaataccctgtcttaatcaaatctcattaaaagtaccccatatttatcaacaaaacatgaaaatccttggacggcttcaaagttcttacagaaaatattctgcctttcctttccatacaaaggcacagcttcgaaactggtaggtgaagggaaggaaaataaggaattctgttacgaaatcatacaggctgttatttggaaatacagaagggtgtatgtactatatgggatactgcatgctatttggaagaattttgtttatttaaacatttcagcaaattcctcagttttgatatggggtgcagtatttttaactcattgagaaatttctactaacttttttgaatgtgctcttttcccactagttgcactaaggaaagaggttagtcatgtggtaaaattaatagtgacaaagctgtaaatagctctgcaggccaaggtagccatagtaagaagtcctggagatttatggaagaaatttttgttcatggaagcctgtcagacatgaagatgtgggtcttgtgaattggagattcagtgcgtgaggaaaacagcctaactatccataattaagctactggaattcagtacgtgaggacttggacttggtgggcacagaatgcatctttttatatcattaaatccaccagaacatctagcatggtcatttgcctaaaacaaagcctctggaaatttagtcaa

SEQ ID NO: 106 - DNA, 560 bp, Homo sapiens
  misc_feature: Incyte ID No: 088974.2
atttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcagttattaaaagagcagagggaactagaagaattgtcgggacatcaggtcgtc

SEQ ID NO: 107 - DNA, 2180 bp, Homo sapiens
  misc_feature: Incyte ID No: 903909.1
  unsure 518, 1268-1303: a, t, c, g, or other
gctcaacgagcggcacaggtacgacgacgtggagtacgaggaggagccagaggcggtggacgagggcctggtacgcaagtgcacggagtggctgcgcggcgtggagtcggcggctgccgcgcggggccgggcgggggccctggactcacggcggcacctgagcacgctgtgagcccagcgggcctgcggggacaggccaggcctgatcccacctcacttcctgcacgcgccactccgcctaggggccctcgggggagaccgcaggctcctctggccgccagcgcccactttcgggacaccggtgcgcaagctggcccacgtggggcgcagccagactcgcccgacggccacggcccccctcctgccctcgccagccggcagcccgggcctttctcgttcacaccggtggtatctaccccatgatgcctgcctctgccctccactcctggcctccgtcttggcatcgccgagcatccatgcagttcgtggccggcaattaagcaactgagaacaatgcncctcttggtgccccgacccccagggttccgtctaggtcccagagaccctctgcctggaggcgggccttccccagggctacatctgcacgccccgtgtgtgtcacccctcagccggctgccgggcacccctggacatgtgcggtgggcagatggccccaggtgtggtggcccgcgaacggtggccttcctgcagatgctgggacccgggtccttacattcgtgattttgttttctcccaagttcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgcttaactggaggctgatttctacatatttcttccatgtatctgagaatatctaacttagaaggatgagaaggaaataaaatgttattaatccagttaaggctggttataaaagagtaatgtattacctcaatttttgactgactttgtaaaagccaataactggtttaatgtttatctttgatagacttttaattggtatcaagtcttaacttgtattttaacattgaaggccttacatttttaaaaccagattttgtatttttcttgtgggagggtctttgctctaataacacannnnnnnnnnnnnnnnnnnnnnnnnnnnnnnnnnnnaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagaggggcaaaactagcaatgcttatgcaagtgacgggtgctgctctttgttccacccgcacccagatggtctctgagtgcgccgtcctgggcagggcacacggtctggagctgagagggtggagcaagagtgcactgacttccgagccgagggcaggagtggctcaacttggtctcgtccttgcacttagtgcaaataccaataattaagatgcctaagacttctgcccttggtcacagtaacaacaacattttgaagacttgtttgccctggtggcattcctatgagggaccgactttctgcagcctctgtcttccaagctgagcttctgctgcagtgtggctgtcactgcacctgtgtgtctccctgacgtccctgtcagctgcttcattttgatttccttttcttctcccgccctttcctgtaggctctgtccccagcatctcctgttccttaactggccacaatacaacactaagcgcattttttagtaatttgtatttattaaatagagtttgtgggccttgttctctactttaaaagcagatgagtggaacatttatgtttccctggtcaatgagcctcaataaaaaacaaacagaaaaaaggttttacacgtgacacatgatatcttttcattgctgttaaggacattttgagaaagttttctaagtcgctatgctccaatttcttaatgcttaaataaaagagaaattcagtg

SEQ ID NO: 108 - DNA, 939 bp, Homo sapiens
  misc_feature: Incyte ID No: 196981.1
cggggtgctggcagaaacccagctctgcgctagcacaatctgtacacctggctgcctttgcccttgagcttctatttcttggggatggggagggcaaaaaagtttgccccagacactggcttctgtttgaacaggaagtggggagtcagtgatcccagaggggacttcagcatcaggacatatgctttggtggcctcagcagacctggcctaggcaggctttcaggtggcacccaggggctttatggcctgcaggtaaggccccttcatccgggtcagacttagcaaataaaaatataggacactcaattaagtttgcattttggataaacagtgaagaagttcctagtgtaagtatgtcccagttctatgtggctgccctacctgggcttgcctctgctggtactagctgcccagagaccttcaggcctgccacgggctgccgggagctctctagtggaattggattaccctgattttgtgcattgtttgtgcttttgtgggcatcggaaatgactgagatacgcagttttgaagagctaggcaggcagctgagcgggataatgtgggccccagttgacctcagtggctgtcatctactgtgtttttcaaccaggaatttcaaatactgtgtattttagaaagaaaggaaagagccaaagtacagccttttctcacttgatcagtaacttgtgttagaaactcagtgggggagaattctttgcgtttttcagttgactgattattttcctttttttcttttttgcttttctcgagtcactctgtgtggtgcttgtgggagaagggagagggtgggagagcgttggtggatgtgttctgcatgttcctttctgtacagtaacttctgcatttactctgtttaggatggttccttcaccactatccctgtctgtagccagtaaatttctggaatattcaa

SEQ ID NO: 109 - DNA, 1913 bp, Homo sapiens
  misc_feature: Incyte ID No: 337888.3
aacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatagatgggataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 110 - DNA, 511 bp, Homo sapiens
  misc_feature: Incyte ID No: 000795.1
  unsure 409-434: a, t, c, g, or other
cccacgcgtccgcccacgcgtccgcccacgcgtccggaaagcttaattctagggaagggattaatgcgtttttggttgtacacaagatagttgcatcatgttagatgcatcatattaggcaatactactaccttattattttatttggaaattaggtatggtttaaggagatgcataggggtgccaaattggcaagggatagacttgtggatttaagtataggtgacaacttgactgtattaaaaaaatacctagtaaagcattatttgggctgtgtctgtgaggttgcttccagaggagatgagtgggtgagtctgagactggactaggcggtgaaaatctgcccttagtgttggtgggcaccttgcagttgaccagggcccagagagagcaaatacagaaattgcannnnnnnnnnnnnnnnnnnnnnnnnngactcttctgctgctgccttggacatcagaaatttgactccacagaagttcgttatcacaacattgactgtgtgtaa

SEQ ID NO: 111 - DNA, 951 bp, Homo sapiens
  misc_feature: Incyte ID No: 3070147CB1
ggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgactggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaag

SEQ ID NO: 112 - protein, 252 aa, Homo sapiens
  misc_feature: Incyte ID No: 3070147CD1
MQLTRCCFVFLVQGSLYLVICGQDDGPPGSEDPERDDHEGQPRPRVPRKRGHISPKSRPMANSTLLGLLAPTGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 113 - DNA, 418 bp, Homo sapiens
  misc_feature: Incyte ID No: 020525.1
gttaagaccaaaaaatattagtgattaaaaaatctgtctctgtctctcttctgtgtggggaatatctgtttttcatttagtgacttttatctagtaatagccactggggagtaggctagaaagcagtgggactacttagagagacttggggcagggctgtaggtgaatgaaatggctttaccaagcagccctacaagcttcactctgggttataggcctcttggcgggggcggggagcgaaagaaagaagagccagacactgcctcaggtggaccctgagcagagacgaaaggaagaaagacagagcagggcatgcatcccaaaaggttgaagataacagaaagaaacaattaagtggataaaactacatcacacgcattgttgctgcaaaggcctatgggaaaaaaaaaaaaaaagg

SEQ ID NO: 114 - DNA, 4989 bp, Homo sapiens
  misc_feature: Incyte ID No: 1382924.38
  unsure 99, 544: a, t, c, g, or other
gctggttcccgggagcagccgtcgagccacaactgcggaggaggagttcgggaaagcggccgtcgggactcctcccctccgtcgtctccgccccggttnagaggcgcctcggcgcatcggagggaccctcccccgcgcttcctcaggctgctgtcgccgctgctgggagatgggcctactcgcccgccaccctgcgctgccgccgctctgaggagttaaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcagtaggctccctgtttcggaggaaaaaagatanacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaaggcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatctccccttcctcctgataggcccagtgctggggcacctcccccacctccaccatcaacatctattagaaatggcttccaagactctccatgtgaagatgagtgggaaagcagattctacttccatccgatttccgatttgcc

SEQ ID NO: 115 - DNA, 1097 bp, Homo sapiens
  misc_feature: Incyte ID No: 4349106CB1
gcggcttccgggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaaatcaacaagataatctctgcatgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaaatattaaaaaaaa

SEQ ID NO: 116 - protein, 126 aa, Homo sapiens
  misc_feature: Incyte ID No: 4349106CD1
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEGKIILW

SEQ ID NO: 117 - DNA, 567 bp, Homo sapiens
  misc_feature: Incyte ID No: 247185.1
taaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaaaacagctttaaatctcaagcttttgcccctaatcttttaaaatttcattgaaataattatcagtttactgtttcactgcaccacaaatttagtttcaggtgtatcttgaaactcattgatatgctaataagttttattaaaattgttaaattccttcctatgaatatactttttatacagatgtgacttaagtatttaaatgttttacttattcacaaaataacaaagaatggc

SEQ ID NO: 118 - DNA, 3495 bp, Homo sapiens
  misc_feature: Incyte ID No: 197587.3
ccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcggagaccagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaagatattatttccggagttcttctttctttcttttttttttttttttagataatttagcaaaaacattactgttctaatgctgaagtgacttttgccagtgccatgtccaggtggtgaggtataagttacttgctcttagcatttggtctgattttttggctttgtggacacctttgagagtatccacaaagcaatgtctcaggtgtggacacctgagagcatgttttagaaagctttgtaccctgtcttgtggcaggaaagaaagaacggggtttacatacaggaataagtcctaggaaatagtcaacgcaaattgcatttgcctttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaatgttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaacacaaaacagaatgttaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaa

SEQ ID NO: 119 - DNA, 2406 bp, Homo sapiens
  misc_feature: Incyte ID No: 403872.1
  unsure 1264: a, t, c, g, or other
gagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgagnatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaagtaaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacata

SEQ ID NO: 120 - DNA, 909 bp, Homo sapiens
  misc_feature: Incyte ID No: 900993.1
ctgcacacagcccagttttctgaacaagtgcatgctcaagagtgtgttttctcatttccatatatttgtaaatttatcaattatttatattattgttttatactctaattccattttttgtcgtagaaggtaatctatgaaatttcggttttaaaaaaatgtgttaaggctttgtttttgggcctaacaggtggtctataaagaagaatattgtatgaggtaatgagaaaggctgtgtatcctgatgattgtacgaggagtgttctctataccttcattagaaataaattgattatttattactgccttctaagtacttactgtttccttactaataattactctcttgttttattattattacagaagtggggtattgaaatatcctactataattatattgctctattcaactttgttagtatttgctttatatatttgaaaccccaatttgagacacacacacgcacaaatacacacatggataaacaaatttgtcataggtttcccatgaattaatctatatattgtttaatgtccttcttttttgaagttttaacttaaagtacattttataaaatatgacagcttttgactttaacaatgtagcttgtgtaatattattttgacctcttctgctctcattttgttagtatttacatgaaatttctacttggtcttgccactttcagtcttttcttatcattagatctcagctgactcttgtaaaaaggcaagttgagtcttgatttttaaaattttttaatgagcctttttagaagtatgtctcttgattggaaagataattatatttaaatagttttctgaaagagaaaaacttactgttaataaaataattgttttgattcttgtatctttgtgtcttaatttctcctttttaagtttttt

SEQ ID NO: 121 - DNA, 5810 bp, Homo sapiens
  misc_feature: Incyte ID No: 228511.1
  unsure 3704, 3726, 3729-3730, 3754, 3840, 3851: a, t, c, g, or other
ttcaacaccaggtggtaagcttattctcccagctccacagattcctccccctaataatgcaagagctcctagccctcaggtggtctatcaggtggccagtaaccaagccgcaggcttaggagtgcaggggcaaactcgagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaacaaaaaggtactatgcagaaaaggcaaacagtaatagtcagcctcagtttatccttctagttgtttcccagatgcttccctctcttcctgcaatactatattaacatttacggggtgtggagctatgtattgtttctattttagtttttaaacttgcaaaattcatgataaagagtcatcgctgtgaccttggagactgacaatcttctatatgtttttttgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaagggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgattttnttttcttttttctttttttttntcnntttttttttgtattatacaccttntaggaactcattttgctgggctgaaaagagtatgggaataatatatctcatgtcattttttagaagaaaaactatttgaaggtatnttttggttttncttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcgatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgattttt

SEQ ID NO: 122 - DNA, 1058 bp, Homo sapiens
  misc_feature: Incyte ID No: 406975.2
ggggaatcggcaggaaatgacccgaactgccagcctgcgcctttgcagccggccctcgctttgctgaagacgagcagctcccaccaaagtcttgcctccccttaccccgaaagccccgctcagttcaatatttcaagtgaaaatctgcctgttcgaaaagaaaatattcacaaatgagcagtgtattagaagacaactgaattgcttctaagaatgggtctcactctgccatcacccaggctggagtgtggtggcacatcatggctcactgcagccttgaactcctgagctcaagtcatcctcccacctcagccttccgagtagctggaactgcaggtgtgagccaccatgcctggctgatttgtctttttaaattttttatagagaccgagtctcaactatattgtccaggctggaaaagaacttctttccctccaagtgataaccttttccagacaagtcagcttaaaaactgacccaaaggccctgaagtacacagttttcttggagaaagaaaaaaataagtgaaaaggacttgctgacttgctaattcattttggggcctgtgggtaacatcagaatggcaaagcacttggggcttttttctaatttgtatttttttaatcttctgagaaatgacttttatatgccaagattcattccatgattagtttttatgaccaagttatgaacgcttttgaatatggggacctagaatagaaatgctaacctacctgcaaggagagctctgtgattggcatccccatcatgctgtaactgacacaaaataaacttagggtaattgccgcatagtgtaactttaatgtgtgagcatactgtaacatctgacaagcttcttgatctagatcagcaatgtgtaacccattcattgttgtcactctcaacaaggccttatggtcaaacatcatcactctcactaaagagatagtttactgaaatatactgagattttgaaactggagtcaagaggtagcacactgttttatgttgatccatttaatggtccttgacagccaataaaaagacactggaagaat

SEQ ID NO: 123 - DNA, 748 bp, Homo sapiens
  misc_feature: Incyte ID No: 200171.17
tccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaaggaaccctgacctcagctgaccccttctaccagaacacacctcacagcagccgctgcgtggcacacagctgagacctgagcccttggtttgtcaatcctaggggacaggagccaggctactgtctgtacccccactgacatcccccagggagaacacccctgcccagctactgtcctaatgaaatgaagagcattgaagcaaaaaaaaa

SEQ ID NO: 124 - DNA, 646 bp, Homo sapiens
  misc_feature: Incyte ID No: 291155.1
tcgggtaggggagatgatctacttttattagaggatacatataaccctaactctccaagcactcgtttctctggcgaggctggtcagtatgtttatttgccatcaccttttctccgtagctattacgtctgggagaaatcaagctaaggacttagcaagctctgatatggcacattccgtgctaggcatgagggtcacagtaagcagctctgcctctcaccacctgtgtgacctttggaaaatgacttttctgtgtcccaatttccttacctgcagatttgaggtaatagatgaggaaacttctcatttttagaattctatgtgttagtacagacaaagtacttagaacagtgcctggcacatagaaattaatatcagtgaggatgatgatggcaaatggaatgatcaagatctctctgcccttaagggccttacgtagcctcatcacctcatcccacatagaatttagggcaggctctctcaactaccaatttgcttggacaatagtcttgtttgccagcacttcagtgagcaggggaatgaaggactcaattcctttctgttctggtctgtctgttctcccaagctcattgtctcagttgaaactctgtgctgtgtaatattttgcatacacagtatggttatg

SEQ ID NO: 125 - DNA, 2172 bp, Homo sapiens
  misc_feature: Incyte ID No: 1383047.1
aatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtgagtttacataatatacagcactggttgcttttgtatttttttacagaaagctttctgtgtgaagcaggtgtatatgtatatattcctcatgtattcttattctgatactatcatttttctttccaaggaaattttaatctgtcatgaccaatagtgttcattacttgtgcctatgataataggtcttttacatcacattaacactaatttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcgaggtttgcctctgtgatttcacagtctgatcctgggaaccagacaaagcactcttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtagg

SEQ ID NO: 126 - DNA, 3546 bp, Homo sapiens
  misc_feature: Incyte ID No: 3230770CB1
agggagagcggcactcgctggcctggatgtggttggatttaggggggctccgcagcaggggtttcgtggcggtggcaagcgctgcaacaggtagacggcgagagacggaccccggccgaggcagggatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccattgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgctgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgacgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaaaaaaaaaa

SEQ ID NO: 127 - protein, 984 aa, Homo sapiens
  misc_feature: Incyte ID No: 3230770CD1
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNAENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 128 - DNA, 845 bp, Homo sapiens
  misc_feature: Incyte ID No: 481453.10
  unsure 287-320: a, t, c, g, or other
agctgcagagagaggacgtggatgctcccttctttggtttccctactttgaagctcgtgtcccactttactcccctttctgaccaattttggctgtgcctaagaatgggggaaaagaagaacatgggcttttgaagcaattgctggcaactgggcacttgcctgtgcactcctcgtgttatcttcatcgagattgagggcccaagtcaccaggaacagaaaggaaagagaaaactcttttctctcttgaacttcctctccgatctttaatattccttcttctttctnnnnnnnnnnnnnnnnnnnnnnnnnnnnnnnnnnccccccacccccacttctaaagcggttcccttctcggctttagagacggcccccccacacttcgctgtgagctgggctgcatcttcctgtaagcgggttcaacttaagaccactgatcccagctgcggggctcgctccagatcctctgtgcttcacgaagttctaagtagcttctccctctgagctacaggatcgacgcaccccacgggggtgtgtgggggtggggtggggagatgtgctgcgccgagcctgctggccgctgggtgcgggagcaccagcttctgcaccagcccagaacgaccgtgggaatccttgcgcggctgcagaccacctctggtgccgcaagcccgctgggccgacagagcgcgccgctttggaacccattttaaaacgcagagtcccctgagctcgccttcttgaggcagcaagggagaccctagcgcgacctgtccacccgcaggaggcgctgggaacggttacaaccaacactgtaatgagcaatgagtccgagagaggggttggggt

SEQ ID NO: 129 - DNA, 492 bp, Homo sapiens
  misc_feature: Incyte ID No: 216141.1
cggacgcgtgggcttttatatataatatttctttctcagtttttccttattatttctaaattctctactctatatgtgtgtttttcagtttatttgtttaggaattcataggactgtttaaatgttcaagttgttactacaaggagaatgtattttgatgcttctttccattaacctttctgttaattcactaacattattaatcattttgtagatttagtgaggaataatttactggttatgttatttggcacatcttaaatgatggcaatttaaaaattattttcaagacttatatattaaagtcctacagttaccaaagaagaataattgatcatctgataacactaaattaaccttaaaatctttatcagataatatttatccattcttattccttttgttagaaagatgttgttacaatgacagggatgtctaaattgtaaactctcctttcaagtgaattaattaaacagtgacattgatgatact

SEQ ID NO: 130 - DNA, 501 bp, Homo sapiens
  misc_feature: Incyte ID No: 158318.1
tggacctgcgcaaaggagcccgctcccaggagggagagatgatgggtgggccttgttaagctgccagcgctgagtcacacatatcaggagctgtcaaggagtccacctgcttctccttgggcaagtcgttccaaaccatggcacttttacatcactcctgcctagtttagctctgtggttcctggaagctgcagatgccctactagtatacctgtagtagcccagacttccttatgtatcaaagttgccgcctcatgtccctcaccctcatgacccttgagttcaattgtcaaggaggtgaaagcataatagggttccaggtagtgcttgataaaggcaatatttggaagcaggtcaagtttacctttggtgtccttccacccactgctgccctcaacccacactgaggctctgttgccacctttgtttttccgggtctcagaaacacatcccaagctgtggacctttcctactttctaaacctccccctgtccctgcccc

SEQ ID NO: 131 - DNA, 3331 bp, Homo sapiens
  misc_feature: Incyte ID No: 408751.3
tagggacccaggatggcagatccgggaccgggctgggctggcttggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctccgcctgagactggacaccaacacctcaacctacctcatgagcctgctggccaatgacactctgaacatcgtggcatcagatcaccggcctttcaccacaaatcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggaaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcgggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccaccacacacactactacacacactacacacacacacacacacacgcacgggttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttttaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccct

SEQ ID NO: 132 - DNA, 263 bp, Homo sapiens
  misc_feature: Incyte ID No: 998310.1
  unsure 5, 24, 98, 102, 107, 188, 192, 194, 203, 222, 241, 248, 252, 259: a, t, c, g, or other
ttagntgcttaacatatgacaganctgtattttaacaaatgacattaaaatacagttctgtcatatgttaagcagctaaagtttctgaaactgcatangtgnaaatnttacaacaggcttatgaatatatttaagcaacatctttttaacctgcaaaatctgttctaacatgtaattgcagataactntgantntctgctgantattttatctttccttggnttttcccttgcttcccctnttgccantctnaacagcnaagt

SEQ ID NO: 133 - DNA, 1426 bp, Homo sapiens
  misc_feature: Incyte ID No: 1097471.1
cacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcctaaaaaaaattcatgtcgataattatattttagcaaatactagttgagcatttataacatgccagagac

SEQ ID NO: 134 - DNA, 527 bp, Homo sapiens
  misc_feature: Incyte ID No: 983843.2
  unsure 347: a, t, c, g, or other
gcccctgtgggtgatactgtgatgaataagacagggttcttgtgttaataactttatagttggctagaggagacatgaacgtggtgggtacaaggtgtcctgagaaagttaagccaatttaacaactatttccaacatctctctagcctgcttttcctttaagtatagggtcatgtatttgtgagcctatgtgttttataaacatgtattagtatttgcacttgtatagtgcttactatgggctagaaactttctagaagctttagagatgtgaactcatctaatatatgattattaaccccccattttacagataagaaaatggaggcaaagacagattggatacntgctgaacttggtggaggagaaggacttgaacttagcagcccagcttgagtctttctatgtgctgtgctgtgctgtcttcccgaagcgggtgcactagcagtataacccaaaaagaggtgtgcagagcttaactgggtgtgtgggctcatgcccttttatcctagctgcccaggaagctg

SEQ ID NO: 135 - DNA, 537 bp, Homo sapiens
  misc_feature: Incyte ID No: 983843.1
cttattacctggtagatttgtttctatcacttaggcctgtttaattacataatacatggttgtagcttatttctttagtagtgataggttcttgaaccgtggaaatcaagcagccataaatgtttaaaaaggaatccgggccagatttattcaaaggaatccgacatttgtaatatgaagactattttaaaaataaccagccttttgtttaactattttgaagtccagagtttccttattgttttttaatgttgggcatttgtttatatccatttttattgatttgaaattaatcccagtggtgtatatgcatgagggtagttgctaggctcggttttggagaaagatcttcactagaggaaaaggaaaacctaaagctctgtttaagtgagggaggaattttggacaggcatcctcagtgatctagtattttgttaagagtatgggaaagagatatatttttatcctggagtcattctgagtcttatgcctcatcagaaattcccatgctttagtttgtgtgtgtgggaaagagat

SEQ ID NO: 136 - DNA, 6426 bp, Homo sapiens
  misc_feature: Incyte ID No: 985607.8
  unsure 2257, 2304, 2308-2309, 2362, 4355-4356, 4374, 4382, 4384, 4396, 4401: a, t, c, g, or other
ttttcttttctttggggccttctgctttttccctgcttccaccacgactgtcttctggctgggaagttgcctccggaaatcctcaacaccatcctcgtgaagtgaactagtaggtgaaggggtggttgaaagacgatcttcaggtgactgggcaggtggcaggatggtgccaccgcctaggctcaaacccagctggggaactcaagttctgactgatcaatggtggtccaactggctatgccccatcaagccagatgtcatgtctgtcattggtacatcaattgtaacaggtgggttggcactatactgagttcctatagagtggtccaagtctgggctgaaaaactgccatcctgtgaagagaaggtctccagtcatcaaagtgccaaccacatctgagacaccaatgagggatcagaatccaaggagataggtgggatttcaaattcctcatcacccaagcttggtgtatggaatgtctcggcccctgacaggaaggggtgcgaaggccctgtgatcgtcaggtaattgtcatttcctccgggaaactcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacntcagagcctaatcttattcagtcctcctttccccattatggaccacntgcnnccttcatccacagtgacagattccaaggtcctgctgtcccctatcagaagtcncacccagacagtttcccctggcttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctcnncctccctccctccccgcnaataagcntnacaaacagtttngaaancttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctgacactgatgaaattccattctaaagaaagaaaactcatattcctcccccccgcaaattgttcccccaaatgctctgggattacctatttcaccactcatttgagtctctgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaacaaaagcagaaggggaaaaagtgtggcaacaagcatcttttaataggatagttgacggtattcaagtgacctactgactccaaataatcaaattgaacacaattgcaaatccaatagaacatcccagtgagacactcgggtatttgagaactttgcttgatttagaaaactggaaagtggcaactaggttagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaaagataaactgttcaattcaagataaattgttcttgtcagtgtttggcatatgatactcaccatttgggtaaaattggattggaacagtcattttgtctacaccagggcttccattcctg

SEQ ID NO: 137 - DNA, 895 bp, Homo sapiens
  misc_feature: Incyte ID No: 152298.2
  unsure 840, 864, 867, 872, 879, 883-884, 888, 890: a, t, c, g, or other
ggcattttgctatggcagcccaaatagactgagacatactccttaacctttgacccacttctgtttaggcccagccagccttcctgagcctgtgcatagtcttcctggctcaaggaactctctctaccgaggtgtgatctcctaactcctggcactcatttacctatccatggttggtagtcagcctccaagatgcctgcagtcatccctgcctcctgggattcatatcctcctccacattgtgccaggattgggctctgtggccaaaaagaaaacagcagatgagaggacgtgtctcttctcagaagggttagaaaagactgtggcttccattttagatgactctctctctctctctctctctctctctctctctctctctctcctcttttccttcttctcttccttggatctcttgctctgaggaaagcaaactactatgttgtgagcagcccaatggagaggcccacaagacaacgaactgaagcctccagcaacaaccctgtgaggtcagtttggaagtggattttctagccccaattgagcttaagatgacttcagcttcagcagacagcttgactgcagcctttctagagagcaagcaccacccagctctgctgcttctagacccctgacctcagaaattgcacgagataacatgtttgctgtttcaggctgccaaatttaggggctggaactgcccataaaggctggcaccccagcagccaccttgagaaatgcagtgatgatgctgagtggcaaggcagaaggcacagggtccctgcacctgaggattgctgctccaaacctgggccaccagcctgaagatcccgacagggngaaataaagctctgttttgctganaanaatanaaaaagnaaannctgntngcaaa

SEQ ID NO: 138 - DNA, 1418 bp, Homo sapiens
  misc_feature: Incyte ID No: 246336.20
gtccagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataagggatgaacacagtgcaggccagagagaccagctgcttcatgggatgtgaaaaatctacttttataaagtagggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagttttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttc

SEQ ID NO: 139 - DNA, 1611 bp, Homo sapiens
  misc_feature: Incyte ID No: 246336.18
tgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaagggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaatgaaaaaaaaaaaaaaa

SEQ ID NO: 140 - DNA, 367 bp, Homo sapiens
  misc_feature: Incyte ID No: 405126.1
  unsure 71: a, t, c, g, or other
gcaggcttggtcgtcgaaatcgagaaactgattctaaacatgtatatgaaaacagacaggacatttaccanccgaaataatagtgaaaaggaagagcgaagttggagtattttcatttcctgacttaaagacttactgtagagcttcagccattgagagagagtggggcgggcatgaggcgtgccaataggtcaatgaaacaggagcggccagagagagacccattcacagatgatgcaagcatttctgacagaggtgtcaaggtaatgcaatgtgaagaaggtagtctttttggcaaacaatttctggaatactggataaatgacaggggacaatggccttaacctctacctgcacgacaacacat

SEQ ID NO: 141 - DNA, 5033 bp, Homo sapiens
  misc_feature: Incyte ID No: 253855.2
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataacttgggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatgggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaa

SEQ ID NO: 142 - DNA, 2623 bp, Homo sapiens
  misc_feature: Incyte ID No: 337187.1
  unsure 2612: a, t, c, g, or other
ggaaaagaaaggtgcagttggggcgggttgttgggggcgaggagaatagcccttctggttcttcagaaccacataatggccagagcatgagcctcacagatccctgagcagacctgcatactagcactttccacaaccagctggccctggctgtgagagtcagatctgtccccaaggctccaggtcagaacttggacccaggtgccttctgaggcaccgccaaggacacatcccagcgccttaggcacctgtaggctagaatgacaccttccaggccagccccagaggccctcagggctccccctccaagccgggagggcaggcaggcacaggccccgctcactacctcagcacccagtgcagccccaggctcccggacgtgctcggcccggtggcctcttgtgtgacaggccctctgccatgtctgtccgcagagccgggtggggagcctccgtgtgggtcctcctctgtccctttgcagctcgcattcgccagagcggagcgcagcccttgtttccttctttcctcttcagctctgacttaaaaacacactatgttccaaatcgttgtgggatcggaaactagaactgcttgtttccaggagagaccaccttttcatattttttttaaaaggaatttgtgcttcaaaagaaactccaaaaaataaatttattgttagtctagcatatgctcattgaaattgacttatgttttattttaaaaaatcatgtaggatctggtacatggggcgggcaaaagggtatcatcagcttaagaagtaaagaagtgagccttccatttgtgtgggtgataacatctttttcctagatcgtacctcaaaattcaggctctccatgaaaacaaagataatctgaataaaaattgtgtgttgggaaatgtatcaagtgaccttcagttaagaaaagcacaggctgtttattagcacaacttgcttcattaaataattcgtggctttttctgccactggggttcttttcgttttgaattcagcttgtgtttggttcctcggtcttgtaccccttcagttcgccggcgacgtaatggtgataccctttgttttttgtatcacaccttttgtgaattgtgacaaccatcccgtaatcattgtggcctcagcagaagttttgaacaatctttgcagccactgttggggtgtgtaccagcagcctggaagtgaccagcagagctgacaaaagcaccccctgctctgcccacctccgcagagtcctgtcctcatcagaaacggtatcgcggatgctcctcaggtaggcgtaggcagacttcattgtgtgttagcagtgacagtgatgtctgtacctatctgtgagtgagacccattcatgacacactagaaatgtgtacattcttttgttttccatcacgggtataggtcttctgccatgaaagagaactatcaaggaaattcctgaaaacaagatttgtaaattcgatttgaccctcccaaattcagggctgctctttgcagtggtccctggcccagcaggtggccggcgtggctcctgttggctcatgccagtgttgtgctggaccctcgagtatgtgactgtcacccttgtccaagactggtttttaacagtcttgatttgtcattttgatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggtctgcttagacacatattcagtgaagattgtattgtgtgtgatattatcctatctttaataaagtcctactactgaaaaacagggatttgcaatgaaaatcatagctaaataggcaggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgtggggttggtcccttctcacgaacccaggacctgtgcttggggaacattttgccatcatgctgttctcttgtaccaaggatcagtgaaagtgttttatcttttttatgtagtttgtattgactggattttataactgtaagaaaacagaaacagagtgttgtattttgatctgaaatttgtgtatgctaaagtaattttgttttatgtattggaagttcacttaaaaacttgaaatattttctagaagggtaccacacaaaaggaatcatctttaagctgtttaattaacctaataaaataatttgatggggaaggcattctaattgtttctgatttttagagtggttcctgctaaatcatcattatcaatacagcntgatttgattt

SEQ ID NO: 143 - DNA, 1281 bp, Homo sapiens
  misc_feature: Incyte ID No: 932244CB1
ctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccacttttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaaaaaaaaaa

SEQ ID NO: 144 - protein, 333 aa, Homo sapiens
  misc_feature: Incyte ID No: 932244CD1
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 145 - DNA, 541 bp, Homo sapiens
  misc_feature: Incyte ID No: 160952.1
ttcaggcggaagatggtgctatgtattattactggactataacggtcacagaatgtaggaggcctcataagttaaaggacacaaccatgtatgtaaaacagggagtacaggcagggtctacaatccctgcatctgcaaaccactcatctgcagaatttatgtcctcatgacatgtgagtgctgtagagagggatttgtccaggccaaggaaaacacaagcacaacacagcagctactcgaggagagtttaacaaagtatatatattcgctaacacaaatctctatgccaacactggagagaacactgtagatggtgacgtatgtaaatggatgagatctggggcccagagatatgaagattagataggagaatggacattagggtacaagttcatgtacaagtgggtcaaaagttaaaaaagaaagagtagaagcgataaggtagacaagtgtgatgctctcaagaatgaggaagaaaagacaaattatgtgtgcctacttgccttgccacaaaactactactaaaatagaacaggttgtt

SEQ ID NO: 146 - DNA, 884 bp, Homo sapiens
  misc_feature: Incyte ID No: 013343.1
aaataattgaaagagttgcacatggcgatttgcgctgagaaaataaagcaaggtaaagagatttaagtgtgagagaagaaaaggggctgtttaaagaggtggttagggaagggctcttctgaggtcaggacatctgagcagcgaaggagccagcgatgggaagcaccggggggcgggggtaggacactccagacggagcaagtacaaaggccctggggcaggaaggaccctgatgtgctggatgaggagcaagagggtgccagtatcgctgagctggagaagaggaagaaaagtgggagaggaagatgaagaagtcacagaggtcaggccatgtgggccttttaggcatggccaaatgcttggattctcttccaaggagaatgggaagtcattggaagatcttaagtagggacatgataagactgatttatactttccaattattactgggactactctgtggggaccagattataggaagatgataataaggtgagtgaaaagagtggccagtcgtggcatccgcctccttccacagagatgagtacaggctgaagtcttgtccgtaagatgcttctgtggaagttacagggagctgaccctggccttggaactaactgtggtgggatcagagaggggggaagcagcagatggtgccagctttggcccaaagatcagaagcagtaaggactctgtgcctctggcaaaaggacaactccatgttttctgtgcagacatccaagttaccatttccccaggcgacattgcagctgtggggcctgtgaacaggacaacagctaaccattctgagtttaaaaaaatcaaggacagtaccctcatgtttataatatagggggcaaagcaaaatccattgacaagcattt

SEQ ID NO: 147 - DNA, 1476 bp, Homo sapiens
  misc_feature: Incyte ID No: 399488.4
  unsure 318: a, t, c, g, or other
tgaactgtgggtagtgatgtggtgtgtttcctaacacctccggcagtgagccaggctttgagtggctgcggctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgccgggatgacaacattgcagcatttaaaagaattcgcctccgtccgcggtacctgagagatgtgtctgaggtggacaccagaaccacaatccanggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaaaaaaaaa

SEQ ID NO: 148 - DNA, 793 bp, Homo sapiens
  misc_feature: Incyte ID No: 399488.5
  unsure 604: a, t, c, g, or other
cataagaccaattgttctcacccttggagctgcccaacttgtcaccagaagtgttctggccagagctggatgctgagaaataggaaagccacggaaaatatttttgcacgaactggagagtaaactaaaaaagttcatgtaacattttctactttatgacacactcagaaaatgctaattttggatggcatacatagacaaactgactctccaaaggggatgttcatgaccaaagtgactggccagacagtctagacaggccaggttctaccttactgccttgaaactgaggaatcaaatatctctgcacacatagtagcttcatttgtggtagcaccaggatgctatagcacatttgctcttgtaatctctgaactaggtgactacaaaggggaccttccccattaaaatcctacaattaaatggcaagaagtggcttcagagagagacagcctatgataaagtgggaatccctggctattagtagagatactaaagccagccttttcaaccagtgggcaactgtgacaccaagccaagtaactcaacagttctcattaatcacagattggccttgaggtgctcctaaatccttattcaaatnccagaagcacattgagatttataaatgtttgatgtacatggtgagccaagagtaaatattgggtaataactgatttagtattgcttagttcttatcctgggtatgcctcaaccgtaacatatcacattgaccaataaatgcttttgcttatccatcttatatactaaactctgaattttttaaagtaaa

SEQ ID NO: 149 - DNA, 143 bp, Homo sapiens
  misc_feature: Incyte ID No: 028048.1
taaaaataaaaaaaacacactcaaaaaataaaaagacattttctttagtccatatctgatccaacaagaaagaggaggaaccaagtcaagaatgagtgaagaagctgggcgcagtaactcacacctgtaatctcagcactttg

SEQ ID NO: 150 - DNA, 410 bp, Homo sapiens
  misc_feature: Incyte ID No: 237622.11
accagatccgcctaaccaatgtggccgtggtacggatgaagcgtgccgggaagcgcttcgaaatcgcctgctacaaaaacaaggtcgtcggctggcggagcggcgtgtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcattaaaagagaaa

SEQ ID NO: 151 - DNA, 1668 bp, Homo sapiens
  misc_feature: Incyte ID No: 237622.6
  unsure 1655, 1658: a, t, c, g, or other
gcctcccggcttctgctccacctgacgcctgcgcagtaagtaagcctgccagacacactgtgacggctgcctgaagctagtgagtcgcggcgccgcgcaactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaactatggcttgngtntctagacaaa

SEQ ID NO: 152 - DNA, 611 bp, Homo sapiens
  misc_feature: Incyte ID No: 026612.1
  unsure 387, 555: a, t, c, g, or other
taggatctatcttgagccttgctgcccaggtatatattgaccacaggtggcttaatttggcttgtacatagtgaagtacatagtacattagcaacattaactaagtattttgagagtacagaatgtagtgtaagccttaagtggggagaagtagttatggaccttgggccttgagaaataagaatgatattgcctgttggacaaaaggaatgtagatttactttctgagtaaataaacatcctgaatgtctcgagatatctccttgtgacttccatctactagtagaggaggactgagacaccctactctttgtggcatacctcactacgcaggcctttgggatttgaaggagcatgactagaagtcctcttgggaagttggtaaantaaaggtaaaattctcccttggtaccaagttagatcaaacatggttcattttgtgcctgtgctgtatcaggtatctgaagtagattctttccaagcttaacctttcagacagtttttaatctataaatattagtgtttaaaagtcaaaaccctgtgaggtcattccancattctggtacctccctcctctctcacgttaccacaaagctatatgttcttttttg

SEQ ID NO: 153 - DNA, 2185 bp, Homo sapiens
  misc_feature: Incyte ID No: 413806.9
gtgcacgcggggcgcggctgcgtgagaggcgcgcggcggcgcagtgaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaagttttgttcctttttaaaggaaataaccacaagatttttcccagcccaaattccagcgccaattttaggccaactttggctgttttcttccaaaagtgcttatgtggaattgggatccccagtgtagtgacagacagtcatgactgctgctgagtttgatctgtgaaggtagtgaaatgtggccctgatgtttcttaaccctgatttggtaactaccagccctgacaccatcagtgcttgatgtagcctggaaccccaggcccactgacgcactgggcacggggctctgggtcgaaggctggagccgtcactgttgttcatgtgcatttggagcactgtgggaatagtctggcagctgtgtgctgattaaatgtctttggcaaggcagggggcaggaaaaggccttgtggaaacaaaggcaccaaggatcaccccagcccagtgaaggcagaagaggtcacgtggatcagcctgtgtctttccagcagaatctgattaaagcctgtaatgctgtagggtgaaggttcagggcagatgtcagcataccgcagtggagactttctgcagtgaaactttatcgatccctagaggggagagagagatgcagctttagcactagttcctgggagtgccagggcctaacaaccccacagagcagacgctaaaaatgcaagaaggtatggacaagtactagtattgggggccacagcaggattaaaatagcattacatccactcagtgtgagacagatgaggaaaccctaggaggaggcgctccctaagaggaatgtctgtcacattcctatgactgcttaaagccagaagggcaaaacatttacccttctgtttagcaggcctgtgtgttttcatgggagacttcatccagattaaggcctatagttattcctctgaatggaaatttggtgtttccttctgccttgtcatttcacttactccttgctgtgactccatgcagtaggttgagtattagcccattttatagacaggctccgagaaaatgtgtcttagccaagatcatccagtgaatggggcagaaccaggatccagaccctggggttctacctcccagtgcaacatactttcacctttcctcggccactttaattctatgaggcctggcttactggggtgactcacaaagccctgagtgacaatgacttcctgagtgtgctggctgacttttccctggatgcttatataaaaacagctgg

SEQ ID NO: 154 - DNA, 547 bp, Homo sapiens
  misc_feature: Incyte ID No: 162569.1
cccacgcgtccgcccacgtgtccgccagactcagcttctgattgagcagaccgggcatggggcctgagagtgtgcattaaaatatataattcattttagaatagctttctaaagtccatggagctccctaatgccccacatggcttcccccattgccaacatggttcattaggatggcacctttgaactgactggagcgatgaactgactggatatattgccgtgatctaaggcccataccttattgaggcctccttagtgtttacacaatgccctcctcttccttcctccccatccaagacaccacattgccttgagttgtcacgtctccctaggatcctcttggtgacaatttctcagattttacttgtttgggattacctgagaatgtacattttaggtggtgctcatgctgctggtcttgggaggacattttatggatggctgattgagctgacgggcagagtcctgcaatctgcagaggtctggaaaggtcccttcccaaataggctggattcatttattaaagactacttttgtaagaaaa

SEQ ID NO: 155 - DNA, 4894 bp, Homo sapiens
  misc_feature: Incyte ID No: 334116.1
  unsure 3053: a, t, c, g, or other
caaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccaggggtatttgctcagtaaatattttggggcagctttccggttatataacacattgacaagtatatgtattaagagtcctgncattgttaactgatttgcaagagaccatgattatcagacactaaaactacttatcttttgaagctacagcatgtgactccccagagctcctgtctgtaggaagtttctaattccactggtatctataaacccttttcaggggagagaccaggagaccaccatcttagatactgtcaaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcacctttttaccaatactttttcattaaattatgaaaactgct

SEQ ID NO: 156 - DNA, 1571 bp, Homo sapiens
  misc_feature: Incyte ID No: 396837.1
gctacagtagcttcagcaacatttgatgtttccagctcttctggatgtggtaagaactttaagtgagagggacaaacaagcatacttacatgttttaaataaccaaataaaattcaaccagttttattatggtaaaatataactttaaaaacatttttaaagaaatagcagattcttggttgactattttaaaagagtaatattgaatatctccttcctgctgaataaagcttgtcattcttcttcaaataaagaggtcaagctgtaaattacagcttgcggaattttgccttctattatgcacaggatcccaggttctgttgggttgtcctggggtgatcatcaggtatggaaaaagataaaagagatatgaaagctgggtaagaatcacaacatttacatctaaattgaattttgtgcaagttccattgactaatggcagagagctgtgcttcaaatacagctgtggtctgagcaaacttggctgctctaaatactgaatgccagttcctttgccaattccatgggcaagcattccaggaggcttgagttaaaatgtgcagataaatactcagttctggagttttttggtgccaaagcatacaaaatacttatgttctgctatggaaatactggaagaacagaacttctgtttttaatatctctgaggatttaaaacagttcttagactacttattacctttcataaaactcactcctactttaaaagtctcttggtggcttacctatattaaaaagaggaaaagaattctttttgattacgctgagttttctcttctctattgaagttaagcaagctaataagaggacagcagaggaaagagtgcagaagtgggactttgggcattttcttaaacttctgtgggcttcagctttctcatttgtaaaatgagaagggtgatgatctcctagattcctttttggagaagcagggaaactaacaacctttaagcacatactgagtgccaagcatttgaaataccgttatttaatccttgtaacaaccctgagatggagacattattgtattctcattaagcagaggaggaacccaaagaacaaagaaattatataatgtgctcaaggtcacaaagttaatacaagatggagctggaatttaaacacagatacatctggtaccaaatgaatgcgtttttccacatccacctgtatgcttgtgagttctagtgctacttagtgaatctcaccagaatagaatacatgacaagtcccttactaaaactggagaaagtcaaagtatattaaagcttggcctgcatatttataaacaagttttctctgacatagataaatatcaagcattagggacagaagacgaataattgacaaagtattgctaagttgctcttattgtgtagaactttcccattttaatggtgactcatactaccataaaaactttgtttggtatttgtttgtgtcttattatatagagtttgatgtaatgcttacatatggcataatgtgtctttaatatgatgttaataaacctttatttaatgcttttgttttttagcatataaaaaaaa

SEQ ID NO: 157 - DNA, 784 bp, Homo sapiens
  misc_feature: Incyte ID No: 406507.1
ggcatgccaaaacaacagttcaatttagtttgttttgcattttatgtaaatggactcatcttgtagatactcctgtgttttgctccttttgtgcaatattatagttgtaaaattcatcaatgttgtatgtagctgaggattgcacatcataatatatatcatgatatatagcattctattgtataaaggaaccacaatttactgtccaatcttctttctttatgcagttgaacatatccagtttggaaatattatgataaagatatttcgaacacttatgtgcgtgtatcttgatgcacataagcgtacatttttgtgggggaatatacctaggagtggattcatgggtcatgcatatctttaacttcagcagataagcagaaagcatttgacaaagtggttgagaaggtaatgagaattcctgttgctccacgttctaataaaaaacacttggattttctttcttttttttcaaatgacagggctctataatgggatcattgcatgttctcatgattactcaatgagagtggagtactccttgcatatgtattagatagatatttgaattgtatttgtttttgttgttgttgtagctcttcatgaaaagtactttctaaacagcatttctgagcaccctttagggagccaaaggccaaataagttagagtatttgtcacaacatggcaataagagaggcgaattcatccattaattgcttgccatatgcttatcactggaatatattttgcagcatctcctgacatcactatttatccctttt

SEQ ID NO: 158 - DNA, 4008 bp, Homo sapiens
  misc_feature: Incyte ID No: 407612.1
  unsure 2653-2952: a, t, c, g, or other
gggagccggcgccgagataaaaagtttttcttgtgaacaagttacactagatggaagataacagactgaggagtgagctgcttctgactcgattaaaaagggagtgagccataactggcggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgcggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaaggcatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcacatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaacaaggtctatgcattattgtatacagtgtctctagtgcttgtatagtgtctggtatacagagggcactcctatgcattttaaaacatgctgagcaca

SEQ ID NO: 159 - DNA, 1043 bp, Homo sapiens
  misc_feature: Incyte ID No: 399501.1
tcttcctactaaactctgcttatttgctttcgactaaatgtactgtgaagctaatcaatttggagtggtgcagcttatggacttggttttctgtgctaagaccctgcgaagtaaggggtggggggacgggaagccaggatgtttagggagcatttctgataaattgcctaaaagatctcaaaacaggtacaaaaattagcttagcattgtagcaggtgcctgtaatcccagctcctcaggaggctgaggcaggagaattccttgaaatgggagtttgggttgcagtgagccaagattgcaccatatcaactgcataccaacttcccacaaaaactgactttttggggactctcacatatctttaaagtaggtcattgaattgatttttttggaggtttctcatattggttgaattattctggtacggactcttgccttatgtagaggtttctatttctcttaagtcagtgtcaatacaatggctggagtttctgtttttgcaacaagaaggtgttggtattttatgtagggtaaatgtgattagaataaacctttggaacagaagtctttattaataaagttttgcaatccacccctgttccaaaaattgatttgattctttcttaggaaaatatacattattattaatactctcatgctacaaaggttttctggttaagctgcagccatcatcattcctaaaaatgaaacattggagacatttgtcaagatactcagtcttcaaacagaaataaaagtagataaaaaaggagttaacataatcagtatagagctattattgtctggtggtgaggacatgaactctggagctggaagtcttggatttggttttgaattttattctgctacttattagctcattggccctgaacaaatctcatgtttcagagccctcagttgtgaaatggagttaataatattactgcttcatggggttgttgtctgaacttagaacaaataatagctattatttgtaaatggttattttatgtagataacccaagagaagtctgggtgttgtg

SEQ ID NO: 160 - DNA, 3300 bp, Homo sapiens
  misc_feature: Incyte ID No: 1004517CB1
ggggcccagtgcgccgcgctcgcagccggtagcgcgccagccgtaggcgtcgctcggcagccgcggggccctaggcgtgccggggagggggcgagggcggccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaggaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacaaacatggatattgttgaacccactgcatgaagcaaaagtatggagcaagacctgtagtgacaaaattacacagtagtggttagtccactgaggaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgctttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttat

SEQ ID NO: 161 - protein, 418 aa, Homo sapiens
  misc_feature: Incyte ID No: 1004517CD1
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFRNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 162 - DNA, 1610 bp, Homo sapiens
  misc_feature: Incyte ID No: 199601.12
cgtatccaaggcctggatgttcctaaactgagagagcactgcagggagcgccccggggccttccccagtgaggagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagttgagggctgcaggttcctgcatgggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggtcgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttccaaaaaaaaaaaaaagg

SEQ ID NO: 163 - DNA, 5608 bp, Homo sapiens
  misc_feature: Incyte ID No: 232946.1
cccgccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattcctcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttagggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaacaatgataaaaaagaccaagcactatcaactttggacagtaatttcctaggtgttaaacaagttttctgaatgcaatctggatgcaaaacggcctgatttgatgaattcataattttcttctgtatactttcattttattaaatattttattacttggttaaacacaagaattatctatgtaaacttcattggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagctggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtgttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttggcaaaaaa

SEQ ID NO: 164 - DNA, 993 bp, Homo sapiens
  misc_feature: Incyte ID No: 988491CB1
gtagatgtctccaaatactcattacatgcatttcatgttaagagtatttggagacatctacgtcaagggagtgaaggaatgtgggcaagaacttactggaaggcagtgtgcttggccctacttcagagctgctcagagggacagtccgcctccatgtcctcacttcttaatcttaagccacctagacttgccatgagggcatagaagaggagatgatgcataaccctgtctcagacaaaggtgttatttagcaggtcttgccaaggtggcaggggcgtgaggccaaggcctcccgggaggccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttaaaaaaaaaa

SEQ ID NO: 165 - protein, 208 aa, Homo sapiens [sequence omitted]

SEQ ID NO: 166 - DNA, 336 bp, Homo sapiens
  misc_feature: Incyte ID No: 199882.12
gctatagtggaggccggagcaggaacagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggt

SEQ ID NO: 167 - DNA, 4892 bp, Homo sapiens
  misc_feature: Incyte ID No: 1674368CB1
attaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcgggaacaaattcctaagggggtt

SEQ ID NO: 168 - protein, 1456 aa, Homo sapiens [sequence omitted]

SEQ ID NO: 169 - DNA, 873 bp, Homo sapiens
  misc_feature: Incyte ID No: 115268.8
  unsure 867: a, t, c, g, or other
cgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggtgagtgcgtacctgctcgcccctgccgcgccgcgccgccttgctggggcctggaggtgtttccagagggtttctgtgctggagcccgggacttggttgcgccctgaaagccttgcctggactcttgccaccctcacagagctgataggtggcctgccgaggaggacgtgtactcatggtggcgtggtgctctagcgccccggaataatcctgaaaatgggaacgctgcctccaagagaccgcgcagcctggagaagtcgccagggacaggatcaggacttgatcctcgcggatcgatatggtctcattcctctagcgttggggtgatgacctactgcccgcctgctgcctgttactgtaaggcctgctaagaattttttctttttttaacttttttgaaggactgaaaagaaataaaaagaaatataatacttggtgacacgtgaaaattacatgaaattacgatttcagtgtccgtaaaattttactggaacacggtcacgctcatttgcatctgtgttttctgtggccgctttcgcattacccagcagggttgagtagcagctggcaaagcccaaagcattcctgtctggcatttacagaaaaagtttcctacccctcatctatcggatgaacttcggtgggaggaagactggagcnacaagg

SEQ ID NO: 170 - DNA, 1084 bp, Homo sapiens
  misc_feature: Incyte ID No: 464689.54
gggtccctcatcccatgcttctccacagttctgacaagtcatgttttggggcggcactgtgcagggaaagcattcagttctcttctgaagttgcaaccctaagacatgcaggtgtgtgactcactttagaaatattgccttgaaaatcacacctggaatggaagcacgtgggaagcaatgtttattggcctaaaacatcaatgtatgtgagcatctcatctcctagtgagaaatgaggaaaaatacctctgggttaaatggcaggaatgagatgctctgtggactgaatgccaggaactggaagtttgccgaaatttcatcatcacatgagaaccttcctagaatagatccagtgtccctgccccctgggtcataggtagcggaattcagttaatccttggcattggcatagagaaacaagttactggggaggcctggggcatggcatccctgccagctggcaggaggaggtggcttgtgtgccttgcaggtgacaatgtgggcagctcatgaaggtaggcttgaagccccaggcaagcccagtgacccggtcacagtgaagtgcctgtgtgtgtaagaaactgacagaacgtgctgtccctgcctcctgctctttcacatgtgtagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 171 - DNA, 3205 bp, Homo sapiens
  misc_feature: Incyte ID No: 222181.1
gtcgaggtgctcatagtggagccctggctcccgggcggacggagccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcacggcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttgggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattcttcgt

SEQ ID NO: 172 - DNA, 776 bp, Homo sapiens
  misc_feature: Incyte ID No: 2951538CB1
gcccctactaaagccttggggttagtacgcgtgcgcacagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaa

SEQ ID NO: 173 - protein, 154 aa, Homo sapiens
  misc_feature: Incyte ID No: 2951538CD1
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 174 - DNA, 1587 bp, Homo sapiens
  misc_feature: Incyte ID No: 1087445.1
cttgtctatccttgttaaacacaagagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtaatgggctatttccaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacac

SEQ ID NO: 175 - DNA, 2779 bp, Homo sapiens
  misc_feature: Incyte ID No: 1079625.3
ggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctgtttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatgccccagttgtctctgctgtcattctgctcaagtccagccaggggtctcagtttgggtttcattctcacattctggatggtgtttagaagaaatagtggagctcttctcattctgagaagaccaaagagggaaagtgatgggagaggggaggtggaaataagattcctaaggtcttaatttgattttttgagaaattcagaggtattggaatatgaaaaacttttagaaggacga

SEQ ID NO: 176 - DNA, 502 bp, Homo sapiens
  misc_feature: Incyte ID No: 1275616CB1
gctagttctagatcgcgaggtccgcccttttttttttttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaa

SEQ ID NO: 177 - protein, 115 aa, Homo sapiens
  misc_feature: Incyte ID No: 1275616CD1
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 178 - DNA, 6634 bp, Homo sapiens
  misc_feature: Incyte ID No: 228046.5
  unsure 4042-4359: a, t, c, g, or other
ggcgcagtgtgctggcagagcatgggcttggaatcagccccgagcttgatttccccaaatctattaaagcagcaccctgataccacttactctgttgcattgttatgaagacttaaggtaacagagctaaacaccagtgcactgcctgtaacagagtgagcacacaataacttacagctcttactgtttacagtgataaccagctacttaatacctggctcatgtttccatgtgccacttgtttcttggtaacaaacaagagtcatggaaatcatgggatgtacagtcagaatggtttcccttgtcctagaatttggataaacctaatgaaatataaaagcaagttgagtttccctagttctgggtggcagggtcctatttaagagagagaagggaatggggaagataagcccagcattactttccaccggctccatccaggagtaaggccaggtgactttggggatgccagttggtgggtagagagcagcgtggctgtgtgcagtgggtaccagcgtggcctggcaccctgggcttcatgctgtgcttcctctggaggcctgggctgagacagtgctcttggtatcctgtgctagattcctaacactgattagtagcatctcttctggcctctggtgtgcttggcttccctaggcatgcagtaccataagctgacagagcacttcgatgagaagcctttcgtcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgacgccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaa

SEQ ID NO: 179 - DNA, 318 bp, Homo sapiens
  misc_feature: Incyte ID No: 1225513.1
ctgtcccgctgcgtgttttcctcttgatcgggaactcctgcttctccttgcctcgaaatggaccccaactggctcctgctcgcctgttggctcctgcaacctgcggccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttatatttttt

SEQ ID NO: 180 - DNA, 335 bp, Homo sapiens
  misc_feature: Incyte ID No: 203438.2
  unsure 330: a, t, c, g, or other
gctcgaggcagagtggcgcagcggaagcgtgctgggcccataacccagaggtcgatggatcgaaaccatcctctgctaggtgcctgttttcttcctccaaaacactgcatcttgcacttgttagaggtgctttaacacctctcatgaatgactgaagacctacagtgaccgagggagtaaactctgttttaactgcctggtgctttctgaaacctagtggttcactttcaaagaacggaagcataagcggagaaatgagtgaatctgcaaatgggaggtctgaaaaataaggcggtagaggagcagagaccggtgtgaagaagggaaagntgagg

SEQ ID NO: 181 - DNA, 2259 bp, Homo sapiens
  misc_feature: Incyte ID No: 232849.13
gatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaaaataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtaagccttatactacattttggaaaattctagaaatggtcctctaaatgtgtgattaccaatattagaatgggagcattttatgacataa

SEQ ID NO: 182 - DNA, 828 bp, Homo sapiens
  misc_feature: Incyte ID No: 019598.1
  unsure 526, 546, 555, 580, 582, 604, 626, 635, 637, 657, 679-680, 696: a, t, c, g, or other
agaggttaagcaacttgctcaaggttgcatgtgcattaaatggcagctggattccaccatggtcttgagaccagaatccactctaacccttttaacctgtgtgttatgctgcctgatgtggtgctcgtgagatggtaaggacaccttcatggttagaggggagactcaatatggggtcatgatgagagaggtcaaataatggagaatctaaaaatcaggcagaaggcattaaactttgtctaggacttattgatatttcatcagtgcggaaacatggtagacatttattttagaaagattagtcagccatagacagaaaggattgagagacaaataagggtaaggatggcaactattagatggaaactattaaaagggggtttctatccaggtatgggtgataggtgattagacctggagtagggtagcagtagaaatgagaaggatgtaatggtgataaggactggaactggcactgaatcaacaggtgagtcaaggccaggtgatttcctgagagcagcttcanggtattacccccattttacngatgagganatacggaggctccaagaggttaatntnggctaataagcattggagcagngatttcagcctatatctatctntcttggctncntctctttaaggtaaaataangcagtctggtcatatagtaganntgctgataaggtttgnagaattgctcccaaaataagagatgcttaaagtcatggggagaaatcaacattcagagggagcaataatatcagagaaaaggcagagactgactattaaagaacactggagggagggaggagggtaaggatt

SEQ ID NO: 183 - DNA, 5833 bp, Homo sapiens
  misc_feature: Incyte ID No: 411148.3
  unsure 3194: a, t, c, g, or other
gacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatcgtttaaattatctttaaataatagcagtagcaatagctgagctaacattaattttatctattttgagactcttttactttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagacaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaaaaaaagaattctaatgaccagccgtgaatgtgtagggttgcagctctattctcccaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccntctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattag

SEQ ID NO: 184 - DNA, 400 bp, Homo sapiens
  misc_feature: Incyte ID No: 444619.13
cttccacgtgcacccactgcctcttcccttctcgcttgggaactctagtctcgcctcgggttgcaatggaccccaactgctcctgtgccgctggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgattccc

SEQ ID NO: 185 - DNA, 328 bp, Homo sapiens
  misc_feature: Incyte ID No: 1383714.1
cacagctcatattcacttgcaagagcattatggggaaactttctccaaggcactggctttcggactggtgatccaagccccagggggggtgccgggacgttcacagctggagcctggggagtggctggcaccaagcctggagccctgcagagcccacttctctccttcctgttcccccaggtttaggctcagcaggtaccagccagatggtagtcatggcaacagctggtggtccagatgctccaaaggaactgctctgcatccctgagggcagagtccagagcctgtggttatcagtcattcctttaacaagtatttattgatcatc

SEQ ID NO: 186 - DNA, 1298 bp, Homo sapiens
  misc_feature: Incyte ID No: 1273641CB1
cccggtgcctgcgggattgctggagagaacgcggcgatggagccgggcaggacccagataaagcttgaccccaggtacacagcagatcttctggaggtgctgaagaccaattacggcatcccctccgcctgcttctctcagcctcccacagcagcccactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtcaacggctgctgctcaccaggaagaagcttcagctgctgatgttgggccctttccaatacgccttcttgaagataacgctgacctggtgggccttgttctcgtccccgacggaatcttatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgaaaaaaaaaaaa

SEQ ID NO: 187 - protein, 224 aa, Homo sapiens
  misc_feature: Incyte ID No: 1273641CD1
MTITSFYAVCFYLLMLVMVEGFGGKEAVLRTLRDTPMMVHTGPCCCCCPCCQRLLLTRKKLQLLMLGPFQYAFLKITLTWWALFSSPTESYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 188 - DNA, 996 bp, Homo sapiens
  misc_feature: Incyte ID No: 403717.1
cctctgccccccggcctccttggaggcgctagcgggacctgcgctcgcagcctctccccagggctgtgcgcttcggcctggcggctgccgggcaaaaacctcatttatttccgttccttcccgagtgagctcacttcctccccgcgccgctcccttccgtcggccggaacccgctcctgggccgcgcggctgcagcggggagcgcggactcgggatgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcctaaggaaagcagccgatggctcccaagacaactctgtccggccagtactccagggcaacttcaaccccactaggacccaggccaaaaccatatatatatatatatatgaattaacgcaaaacagagccactttggtgcctacccctccacaagtaggtaggcacatccaggtagctctgtcagaagatgggacctggcgccttgcaggggtagccctatggagatccagaagccccgtttcgagctacgaagtctctcttctactgcagtcttctctccaacgtggagatctagcaacttccctccccctgggattccctgtgaatccactctagttgggatatagcctctctacagctcagtgacgtagcgcgccaaaaccaagtacccaccccggcaactggaagacctagctgtcctccatcccgcctccgcagtcgataatctccaggatccaagcaaagtgcctgtccacgttgtcaccagatccacaagcgcttttgatgagagctgctacccttttggaaacacgattccctctccctagtagagaagaatctattcttctgggctggcgtagacaaagaataaccaagataaagtatgtggtgtgaaaataaataaaaaa

SEQ ID NO: 189 - DNA, 1642 bp, Homo sapiens
  misc_feature: Incyte ID No: 332165.8
  unsure 133: a, t, c, g, or other
gattacaccatgtaggtcagtataaagagggcagtcactcctccatttctcccagcgtgtccagttcagcagatttctaaagctgttaagcagcctctctttttgaccgtcctaaactttgtgaaaataaatnaccccacaccagataaccattaatagaagtaatgtagttttttaggcttttggaatatgtcttctcttttgtatttatgatggtgtttggaatttttcactagtgtatttttagactgaagtgggtgcattaggataaaactttcccttgctgagcctgaaggcaagcaagagggaagaaattgacctgtattgtatcattggggaggcgactacttcttgtggtggtagggggtggggggaatggggcattgtagattatgtgggggtacaatagaattctggcctgaggctccccaagtcttattaccttgtatgaaaaatccccatattagcctcacttaatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgtaccaagtctcttaaatattgaaatcttgtagacttcttgtgcttctgtgttttgctttcctatcaggccatgtaggaaactgtgttcttgttattggtagaggggccctcactgaaatccaagcttggaaggatgtcctgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcac

SEQ ID NO: 190 - DNA, 913 bp, Homo sapiens
  misc_feature: Incyte ID No: 1098877.1
gcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacactgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaagaactcacagggctttttggtgcagagtctggagataatgcacagaaatgacaccttgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaagaaagccatctgccgtgtgactggtgggatgaaggtaaaggcagaccgagatgaatcctcaccatatgctgctatgttggctgcccaggatgtggcccagaggtgcaaggaactgggtattactgccttacacatcaaacaccgggccacaggaggaaataggacaaagacccctggacctggggcccagtcggccctcagagcccttgcccgctcgggtatgaagatcgggcggatagaggacgtcacccccatcccctctgacagcactcgcaggaaggggggtcgccgtggtcgccgtctgtgaacaagattcctcaaaatattttctgttaataaattgccttcatgc

SEQ ID NO: 191 - DNA, 731 bp, Homo sapiens
  misc_feature: Incyte ID No: 251867.2
  unsure 538: a, t, c, g, or other
cggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggggcagctcccctgccccagccaaatcctgccccgtctcttctagttcaatttagctccgcccaagggctaggttcaaccgcgtagccctcggccccgccgctccccggcccactcgaggccccgcccaacccttctcaaacccaatctcccgcctgtactcctgcctcaaccaacccagtctccaccgggctctgcgaggcctcgcccaggtctgcactgcacaccgcccccaggcccggccctccccactatcgccaagccccgccccttcccactccgaccgagcgggcntctgtcctaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacgg

SEQ ID NO: 192 - DNA, 586 bp, Homo sapiens
  misc_feature: Incyte ID No: 005597.1
caaaacaaaatcatgatgccatgatcagtgtttacttttggataaacacccggacacatgatagagaataaatgtttgagagagagaaatgacctactgggtaacaccaaaaactaatgtataccatgtctagtgtttacagtttacaagatgctttcacacacataacttcatttgatcctcccggcaactctgcaaaatagatttctgcagccctgttgtactgaccaggaaacatcagcctgccctgatggcagggatgtggttagcaggtggaaagccaggactcaggctcaggtcttcgaacccagattttatgccctatgtaccgccatgtggatattctcaaggcaactctctgaaatatttccagaatctttcacaaaagtcctgtgtcgtcctcgtcctggccaactagactcagagggaggactgatggattttcatctccctcttccccttcgtcttttcttctcagcatcttcctaccctccccaccaccgcgcttctccaccaaaagtctgatgctggcatgtaatggaccctttccaagtttcaaggtgttgacagtaaatcttttgtattt

SEQ ID NO: 193 - DNA, 1973 bp, Homo sapiens
  misc_feature: Incyte ID No: 235356.1
  unsure 614: a, t, c, g, or other
ggatagttaaggcactggggtgagcaatgaacctggactcacggaacactgggctctgtgaccgtttccctgaatggcctaagctgttgcctcctgtcacttctctgaggtcattttccaaatgcgcacgggcatagagaacccatccactctgcctacttcccagggatgccttgagcactgaggatacctgggggacatgaagtcgcactgtcctgggggtcgggacaccccagccagggacagagcatggcacagggacatcgaggcccagtgagccgaccctttgtcctcctctctgagagcactagtccccagcaggcctcagggtgctgactctgtctcttttccaggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacactacagcccttaccctcctcaggactaccgaaccttctggcacaccttgtacagagttttggggttcacaccccaaaatgacccaacgatgtccacacaccagcaaanaccagccaatgggccacctcttcctccaagcccagatgcagagatggacatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagcttaggatcacactccaagtatgggcagtgatggcgctctgggggccacagtgggctatctaggtcctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcgg

SEQ ID NO: 194 - DNA, 794 bp, Homo sapiens
  misc_feature: Incyte ID No: 047593.1
  unsure 502-546, 605-661: a, t, c, g, or other
ccagcaagtactgagctttaactgtttccaaatggggcttctgagaggcactgagttggcatctaccaaggacttggtctacacatagagggaagacagagaccaggaaacactcatctttctgcaattcaactctgggctccatcttgaaggaaatgaatgcatgaagaacattcttaacctagtatgtctacggccataccaccctaggcgtgcccaatctcgtctgaacccagtacgtgacatgccctatgctgatgctttcatatgcgttaccttatttaatcctcatgacttccacattaataataattacctatgatgtgagagggtcattataccaattttatgaagaaaatatggctcaaagaaataatttttaagtagcaacaccaacatttggaatcttcttgaaacttctaactcctagaagaccaccatgctgtatttttggtctacaaatttaaatggaatagtatctaatgttggggaaaacgggagnnnnnnnnnnnnnnnnnnnnnnnnnnnnnnnnnnnnnnnnnnnnngatgaaaatgttctaaaattgacagtgatgaccattgctcaactccatgaggactctannnnnnnnnnnnnnnnnnnnnnnnnnnnnnnnnnnnnnnnnnnnnnnnnnnnnnnnncacacagagctgttacaaataagtaatatttaatggaggcctcttcccaccctactctacaacagtcacaaaaacctctcaattttcccatatatcctgaagtagaagggcttgccttttatctctttgtaat

SEQ ID NO: 195 - DNA, 1770 bp, Homo sapiens
  misc_feature: Incyte ID No: 995887.12
  unsure 846, 851: a, t, c, g, or other
ccgtcccggcggtaatgcgctcccggccgtgacccccgctggggcgggggccgggatccatgcgcggagcccccacccggcccggcgcctgcggctgacggcggcgggggttggggggcgcgcgtctggcctcctgcccaccccctggcgtcgacattcacgggccgtctgggggctgcgccctaccccgcggccaggctctggagggaccctggagttgtgccgccggcctcagcccatggcccgaaggtacgatgagctgccgactacccaggcatcgcggatggccccgagccctggctggcttcccagaggcatgtgcccgcggcaccgggccctatggccctcacgtgtcctccccgagcctcttacccccaaggctttggacagcgacggcctgaagagggacaaggatgagatctatggacacccgctcttccccgtcttggcccctggtctttgagaaatgtgaactggctacatgctctccccgtgatggggccggagctgggctggggacaccccgcggcggcgacgtctgctcctctgattccttcaacgaggacaacactgccttcgccaagcaggttcgctctgagaggcccttcttctcctccaacccagaactggacaatctgatgatccaggcaatccaagtgctgcggttccacctgctagagctggagaagggaaagatgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccangtccntccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacggagccg

SEQ ID NO: 196 - DNA, 3119 bp, Homo sapiens
  misc_feature: Incyte ID No: 245687.1
  unsure 2672-2702, 2730-2733, 2735-2737, 2867: a, t, c, g, or other
agcaactcactgtaagtactgtagaaacaaactgaaagttgggttagaaaaaaaaaaagaagaaggtccaagtagtctgaaggactcgggaggccaagatgggaagtccacccagatgacaccggggagatcgaggctgcagagaataaggatcacatccctctgctggacctgaatggtactgatgctgttgagagccatctggtcctcagacatgggaaggcaagagccatctgttcgaccttagacatggcaagatgaaagctaagtccagtgctcgctgccaacacggtttctcaaaataaataaacaaaaatttcaacagtaaatattcaacaataacaaagaaataataacaactttaaagaccaataagtaaataagtgaaagtgaacaaaggtaataggtgattaatatcacaattaagatcttctatctctcctacttctctgttactctctagctgtctctgtttgtcaaacccatgctagagtgtgattaaaagaaatataaaagtcaactgcttcctgcaggaaggagcatagggacataacgagagaaaagaacaaaggaaaaaaaaaaaaacagcaagtcactctatgtatgtggaaacaaactgaaagtggggttagagaaaaaaaagaaggtccgagtagtctgagggactcaagtggctgagatgggaacaccagccgggtgagactggagagatcaaggttacagtgaatcacaattacctccctctgctggacctgaacggtattaccggaggcaagagccatctggtcgaccttagacatggcaaggcaaaagtcctctggttgaccttggtccaatgctcgtggctgacatctctctcaaaataagtaagcagaaaatccaccagtgaatatttaccaataaaaaaagataacattgtgtcaataaataggagtgaacaaaggtgaaaagtaatcgataacacaattaagatgttctcctctctctctctctctctgtttgtaacacccagactggagtgggttcatatttatcatgctggaaggagtgtagaaaaatagaggaatgaagaaggaaaacaacgcaagtcattctatgtactgtggaaacaaactgacagtgggtttagaaaaaaacaacagaggaagaaggtctgagtagtcccaggtaattgggaaaccgagaagggaagaccacatcgggatgagaccagggagatcgaagccagcagtaaatcacgatcacatccctctgctggacctgaacggtactgccgcctgcaagagccatctggtcgaccttagacatgacaaggcgagaaccatctggtcaaaccttacgacatggcactcttgtggctaagtccaactctagttgctgaaatacgtctcaaaaaaacaaaaacaatccaacagtaaaagttttacaaaaacaaaaaaataaacaatattaaagaacaatgtataaataagtgggagtgaaccaaggtaaaaggtaattaatatcaccattaagatctcctctctttctctttttctctccatttgtgatacccaggctggagtgtgacaaaggaaaatctaaaaggtcaacttcatttacaggaaagagcataggaaaacagacaaaagaacaaagaagaaaaacaatagcaagtcactctaagtactgtggaaataaactaaatgtcaggttaggaatagaacagtgaaagaaggtcccagtagtcccaaggactcgggaggctgagacacgaagactgcccaggtgagactacagagactgaagttgcagtgaatcatcacatcctgctactggacttgaacagtactgctgctgatgagagccatctgggcgaccttcgacatggcaaggtgcaagccatctgatcagccttagacatggcaaggtgaaagccatcttggtcaaccttagacataggaagttgagagccacatggtctacttaaggcatggcaaggcaacaagcatctggtcaacctcaaacatggcaaggcaagagccatctggtcaacattagagatggtaatgcaagaggcttcagatccatcttagacatggtaaggcaagaagcatctcatctagcttagacatggcaaatcaagagccatgtggtccaccttagtcatgggaaggtgagagccatctcgttgaccatagaacaggcaaggtgggcagcatcaagtccacctcagacatgggaaagtgagagccatctgatctacttcagacatggcaaggcaagaggcatcttgttgacctcagacatggcgaggaaagagccatctggtcaatcttaaacatggcaaggtgagatccaacttgaccttagatatgatgaggtgagaaccaactgttcaatcttagacatggctaggcaagtgccatctggtccaccttagatatggcaaggcgagagccatctggtcgaccttagacatggcaaggtgagagctgtctgttcatcttagacatgacaagctggcagctaaatgcgatgcatgcagtcgacatccatctcaaaataaatgaaccaacagtaaatatataacaataacaaggaaataatagtgaacaaccctaaagaccaaataattaagtaggagtgtacaataataaaaggtaattaatgtcgcaatttaaaaaaactcnnnnnnnnnnnnnnnnnnnnnnnnnnnnnnnacacacagggtgaagtgtaaccaaaaannnngnnngaaaaaaatccaaaggtcaaactcagtttgcaggaaggagcataggagaataaaggatggaacaaagaagaaaaagaacagcaagttactctgagtattgtggaaacaaactgaaattagagtgagaganagagagaaaaaaaaagaaggtccgagcaatctcagatatatgagaggccaagatgggaagatcacttgggtaagactgggaagattgagtctgcagtgagtcacagtcgcatcattctgctggatttgaatggtactgcttctggcccaagttgtctgggcaaccttagacatggtaaggcaagagccatctgatcaacattagacatggcaaggtgaaagccatctggtcgacagggattctaatagaaga

SEQ ID NO: 197 - DNA, 658 bp, Homo sapiens
  misc_feature: Incyte ID No: 1571349CB1
ctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcacaaaaaaaaaa

SEQ ID NO: 198 - protein, 148 aa, Homo sapiens
  misc_feature: Incyte ID No: 1571349CD1
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 199 - DNA, 1125 bp, Homo sapiens
  misc_feature: Incyte ID No: 336735.1
caggcacgcaagcagacacaccttattctctacagcatcatttatacctcaactaagtcagctgaacaaatgcctgctgaaaagttctgggagtggcatagctaagaaccagaaaggcgatctttcttttggattaagtcaacagagtcatacccacaaggagaactatcaaatatcagatgcgagaggtgaagtggggttataaggtgagagctgagaagggagaaacagggtgagtaaacctccatgactcagacgaatactgaactttgcatttcaggaagaatgagggtttgggttgcttctttttctttttaaaaacctcttcttttcagtattccttggggggcggggttctcagaggattaagggtttggaaaattaaacagataagatactaagagttaaataacacataagaggaagaaggattagaaagaggaagaagaaaagtagaaagtgtggtaggtaccttcctacctcaaggtagaagtagtgtgtttctaagtacagagatagattttgtctgattggggagaaatcctgccaaaaggattaggaagtgagtgagctgagagatgaattccagggattggaggtcatacagagagcagggaagcacaaaactagggcatggagttttgggtggaactgaggagcgtaaaaaaaaagtgctgaagttgtgagctgggaaaggtatcaagtacataatttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggcctttggtgctgaaagactttgagagattatcaggtacagcagttgacatataggtgatgcatcagaaacacccacagagcttttaaaagatacaccttagatatatcaaaccagaactatatatcaaaccagaaacttttggcgatgtcgtccaggcatacata

SEQ ID NO: 200 - DNA, 1332 bp, Homo sapiens
  misc_feature: Incyte ID No: 040322.1
ctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtgaaaaacaaaaaaaaaaggg

SEQ ID NO: 201 - DNA, 4570 bp, Homo sapiens
  misc_feature: Incyte ID No: 205542.2
  unsure 3900, 3919, 3934: a, t, c, g, or other
agcagcagcaaggcgcaccgccactgtctgccgctgcagccaggctgctccgaaggccggcgtggcggcaaccggcacctcagtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgancaaatgtgcacattacatnaattaagtccactgntacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaaaagaaaaaaaaaat

SEQ ID NO: 202 - DNA, 5037 bp, Homo sapiens
  misc_feature: Incyte ID No: 1867417CB1
gcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaa

SEQ ID NO: 203 - protein, 1531 aa, Homo sapiens
  misc_feature: Incyte ID No: 1867417CD1
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 204 - DNA, 402 bp, Homo sapiens
  misc_feature: Incyte ID No: 402521.1
ccgagagggaacccgatccacacggatccccacctcccgccggcgacaagcggcgccgatgcaagcgtctccgctcgcacgtgcacgggaagcgggcagtaggtggtgccgttcgggctccagcgctagtcttccttcggtgccaggcccgcgccccgggatttggagggagggagaagggaggatggcttgtgctgaaagaaacaagaatgaagtcgggcagccgggatctgagaaatgggaaatccatggcccttgttcgggaccacaggctttgccgacgtggtctctcctagttccgaaattgcccaggcccgcctccccactctctgcaagcagcgggaacgacttccacatcgcttaatttctttattaaacttttcacctattctcttctaaagg

SEQ ID NO: 205 - DNA, 254 bp, Homo sapiens
  misc_feature: Incyte ID No: 219537.2
gaagtcgcccgtgctgccggagaaaccgagactcgctcttgggacggttgcaaacagctccggagaaactcagcccgcagcacgccgcccgccgcccgccgcccgcttgtgcgcccgcaggttcctcgccgtggataatctgcccgagctgcttcgcaggcccggccgccaggttggggatttagagccccatctgtttgcggcggacgcggcttccctaatgcgcagaattgtgcagacccagactgtcctaa

SEQ ID NO: 206 - DNA, 545 bp, Homo sapiens
  misc_feature: Incyte ID No: 219537.1
tttcactagagattgggtggcatctcttttattaattattaacaggccgaaacgtactggacgttaagatgagctgcttgagatgaaatctttctatataatgtgcccacagcaaattttctcttttcccctgtggcttgaggggaatgggatttaatcatttttagaatatgtaattcatataagtaaaagagaggaaacctcccgtgatccgcgctcttaagcacttaaaattatttgggaggaaaaattattaagatttcttatcgacttcttatgttaaaaaatctattctcccccaccccccccaaaaaacttttatgctagtcctgcatttcattagccctgtaagtgtgaaacgtcttaaatgccctctgcagttaaagcattttttgtctttaaattataaaattgattttgctatttggaagatgtcaatgccagtctttatccactttgtctaatatactttgtgttgattggaggaaaggcgagaggctgagacattttaaactgctttctcccctaatgaacagtaacgaccc

SEQ ID NO: 207 - DNA, 3955 bp, Homo sapiens
  misc_feature: Incyte ID No: 1041138.7
  unsure 2235, 2268: a, t, c, g, or other
tgtagaagtttgattttgatgtcagtgtggtagatgaatttgtgggaagcaaaacaagatagagttcaatgacagtgaaaagtttattgtataagctatataaaagaaaatgttgaaggtttgaaatccattagtggcagtaagggtgtacagaacgaaactatttgagaagtacacaaggcaagtcttactttcaaggcagtttatgtaagctcattcaattgtctcagtgttcttgctatgtgtgggttataggatttggaacatatgatcaatctgagcacacatcagtaaactgaataggattattaaaatccacaagcattttactagtggaatctgtgatattttctagctactcttgcttgttttatttgaatcttttgctcatatcctatagtaaagatttcaggaaatatatttttatttgcctagaattttagccttttagttttttgaatctattgctcatattcttatagtaagagtttcagggaatgtatttctatttgtctggaattttagcctttcaggtttttgagcccctcttttgcttatgggacatagtatgagacaagatgaaatgatacttctattcccaattcactgatggggaaaatgaagcaaaaaatgttattcactcaaggcttctgccatgtttcctggtggaattacggctcagacacaaatttcctaatgcctgtgctgctaacttctcaatagaacactatattaatttatcttcttcctgagtgtttttccacaaatcccatagcctgtgaaaagattgttttagggaaatattatttttaatatagcatattttgtcaatgtgggacataggactagtacctgctgaaaaccatctcatgatccttgtgtaagaactaattcacactagaaatactattttccttgctcattaaaaacataaatgtctcagaaagtaaaaaattattcctctctaaataaacatacatgccactcaaattttattcctctaccacttgccgtatctaaacctagttagatactttggttttaggtataatctgacagaacagatacaaccaagatcacattgtgagtcagaagtggaaaattcataattcatgatgataccaataaaagatagatttagctttttacaggatgtttttggcattttattctttcatttgaggggagatctcaccaaaatatgtctttcatggttcattgtgttatttaatttctgtgatgcatattctcaggttactttaaacctagtctatagattcaaagatatcccgtgtcaggtctctaaaagtaaaaagaaaaatgggtacttgtgaaggctgattcacagtaagtagtgtagaggggagtgccttgtgtattcacaaattatcaacgtgagcatcagataagattttctttagtcacacacacctaccttcttactaggaagatccatatacttgaataattgttctgcttgacccaggttacttatcagtccctttattataatatttgtaaatattggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggangaggaaggtgaagaggaggacgtgagtggagangaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaacccaaaaaa

SEQ ID NO: 208 - DNA, 381 bp, Homo sapiens
  misc_feature: Incyte ID No: 049272.1
  unsure 361, 364: a, t, c, g, or other
cggacgcgtgggctgatgtcaatgttttggatgcacatttcccacatggatagggtttactgaatatgaaggataataatagagaagatatttggctaattaaaagtttcttttcctaataaagctagatttcaatagttataactgtacctagagcaataccttattatatagtatgtgctcaataaggtttcataaaaataaatgaatttaaaacaaagtaccccccaaaattagaatctctggttggtttagaataaaagatggtaaataattttatagtataaaatatcctactaggatattttctaatatgtagtctctctcaattaaaatgaagaaaagaggtgggttgagaganagncgggagagagtgagaga

SEQ ID NO: 209 - DNA, 1005 bp, Homo sapiens
  misc_feature: Incyte ID No: 221433.21
tgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgctgagctggcgttgctcccgccaccgccggcgccggcggcgattccggggaaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgtggactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaata

SEQ ID NO: 210 - DNA, 2916 bp, Homo sapiens
  misc_feature: Incyte ID No: 232386.18
  unsure 1965-2021, 2478, 2546, 2599, 2637, 2642, 2687, 2699, 2707, 2716, 2721,2727, 2745, 2747, 2754, 2764-2765, 2769, 2781-2782, 2797, 2812-2814, 2818,2827, 2833, 2837, 2842, 2845, 2849, 2855, 2868, 2875, 2878, 2884, 2889, 2893,2895, 2898, 2902-2904, 2906-2907, 2910: a, t, c, g, or other
gcgttcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaacaccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcggtcgtgtggaacttcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactggcaagatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattnnnnnnnnnnnnnnnnnnnnnnnnnnnnnnnnnnnnnnnnnnnnnnnnnnnnnnnnnccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttnctttgtggttcctttaaacacactcacacacacttggtcagagatgctgtgcttcttggaagcaaggnctcaaaggcaaggtgcacgcagagggacgtttgagtctgggatgaagcatgtncgtattatttatatgatggaatttcacgtttttatgtnaagcntgacaacaccaggcaggtatgagaggaaagcaaggcccgtccatngctgtccgtacncttacggnttgcttgtnggagncatttnggtattgtttgttgtaananccaaaangggctttggnntggnaaaagggcaganngggggggttggtgtngttttttggggggannntttngatttggtnccgggntttngtttnccncggnaccggnttttggttggggnccatttntgnggggcnttggngttncnttncccnnntnngantggttt

SEQ ID NO: 211 - DNA, 3043 bp, Homo sapiens
  misc_feature: Incyte ID No: 2598244CB1
  unsure 3035, 3037, 3039-3040: a, t, c, g, or other
gcgacacgcgacacagcgccggccacaggagcatcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgaacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagtttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaananannaaa

SEQ ID NO: 212 - protein, 267 aa, Homo sapiens
  misc_feature: Incyte ID No: 2598244CD1
MKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 213 - DNA, 3760 bp, Homo sapiens
  misc_feature: Incyte ID No: 2173757CB1
cgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgacacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatggaaaaaaaaaaa

SEQ ID NO: 214 - protein, 1032 aa, Homo sapiens
  misc_feature: Incyte ID No: 2173757CD1
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMTQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 215 - DNA, 1248 bp, Homo sapiens
  misc_feature: Incyte ID No: 1405844CB1
cggggaagtcaggcagtggtttctgaaagccaagaacttagtagcactgtgccattctcttgcctgatccagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagttacctcctagacttatggaccacatttaagatttgagggatataggggaaatgatatgaatgtgtatttt

SEQ ID NO: 216 - protein, 237 aa, Homo sapiens
  misc_feature: Incyte ID No: 1405844CD1
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 217 - DNA, 1734 bp, Homo sapiens
  misc_feature: Incyte ID No: 1143377.5
cgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagtaagaatttttttgagggaagtattttttgtaaccacatgatgatcctatacagctgcccagaggaggacaccatcagagtcattaacatgccgtatgcgttctgaataaataaaagctacaaagcccaagttatatacaaatatctcaggcaataatgtttacaaacctatgtacaataaaacaaatgtaaacagtaaatgcagcatgagagtaatcaaaggatgcacagggacagccgccgctgttcagtccaccccggagctggcaccggcccaccctggaaccagccactcacccttcctaacacaacgggacggcccttggaagagaaaacaaaaacactccaaagatgtcgttgaactgaaggacgggaaggctggcgagaggctgcccgcctccctcaccccgagtctgaggcgcacagaggaggagacagcacagaggctggcttcagctcaccctaaggtccccacatctccctcagaacaggctcacctcttggcaatccctgccctggtgctctgtcttgggaggcaagtggcaggcaggagtagcgaccctgaacagacagtgttatccttccctcctcgtgactgttcttcagggcttccacacgcacagcacatttccgggttcagctcaggaagtaaagcctacacttacatctcggatgctctcaaggggcagaggtgcagtcagtgtgcccaaggcctgttcctg

SEQ ID NO: 218 - DNA, 5203 bp, Homo sapiens
  misc_feature: Incyte ID No: 235147.1
cccgcttccggttgggcggtgcttgcgcgcgtgagctgagccggtgggtgagcggcggccacggcatcctgtgctgtgggggctacgaggaaagatctaattatcatggacctgcaacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttatatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaatattttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattaggccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattttgagaacctcgagagaattaaactattaactttagtaaacacacagtttaagacaaatataaaggtttagccaaatgcaacggggaggaagcacctggaataatttgtgcttgctcaggggcttgtggacatggctgttcctgccaaagctgtagcagttatccaaaagttctttcaaactcatatttggggccactgagttttttttgtttttttttttgttttgttttgttttttctttatgtctctcccatttctaaagtgttttcttaagtttgttctaattcagcatatatcatctcagaatggatccccagcaggaaaaaaaaaaaaagttactaaaaaggaaagtatccatacactggaaaacttaaagcatatcccttttgggtggcctggtatgtagaaatcagttctccaagtgctgtgaatggtgccacttaggagtagaaactgatgattgttgaaatggcctttgggtggtctgaaatagaccagtggaaacagtagctttgtaggcaagaaggcaatagtaagaaaatgaaaaattgactccccaaactgccatcactccttttaccatcttttttgtgtttttagtagtttggtttctgacggagacaatagaaacttacttaaaagtaaaatttaattctagctgttgcaaacaggccaatattgggtcctcagttggggccaacttgggtagacgagacagtagaaacttctgttttctgggagctgcatgtgtcggattcatctgtcatggccttcccacacaccatcttcatgatgcaagcttggaactggagagaaaggtacaattggagataaccttggcagatgaggaagtatgggaaaaaagaccttattctctgtatcaccaaagccttgcacaatgctttgtacccagaatgcccttaggtggttttgaatctatcttccccatcctgaaaactatctagattccagtctagaactactcctgggtctacggtaatcctaaactggtcaagtctgagacctcactgttggtaaattcacaaaccatcctgcttcataaaagcactgtcagcagaggcccctccattactagcaggtgctcccagctggaaaggactgccaattctcttctatccagggaggtttcaaattagttttgagtctacctctgggattgaggaaacaataccatctgaaagtagggtttttgccacttagggtttggtgtttattagctcggatttcagatgggataggaaatcccccagtaccttcagatgataagatattttagagatttttgcatgtggtatgatttctgtgcttcacacatgctcgtgcaggctaaaagttggaagggaaatgattaagaaattattaaatgcaaggactgaaaattgagaggaatctgagtttttatttttatttttttaattttatttaagttccaggatacatgt

SEQ ID NO: 219 - DNA, 1569 bp, Homo sapiens
  misc_feature: Incyte ID No: 235147.20
cccgcttccggttgggcggtgcttgcgcgcgtgagctgagccggtgggtgagcggcggccacgggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattttgagaacctcgagagaattaaactattaactttagtaaacacacagtttaagacaaatataaaggtttagccaaatgcaacggggaggaagcacctggaataatttgtgcttgctcaggggcttgtggacatggctgttcctgccaaagctgtagcagttatccaaaagttctttcaaactcatatttggggccactgagttttttttgttttttttttggtttggtttggttttttctttatgtctctcccatttctaaagtgtttccttaagttggtcctaattcagcatatttcatctcagaatggatccccagcagg

SEQ ID NO: 220 - DNA, 1084 bp, Homo sapiens
  misc_feature: Incyte ID No: 1099294.6
caccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaggggaagaaacgacagcctcacttctgtatggactgctgatgtggcctgccatcctgttcagcgggcattgtctttggagcagcaggagactaggatgcctctcactcacatcgagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaag

SEQ ID NO: 221 - DNA, 961 bp, Homo sapiens
  misc_feature: Incyte ID No: 330927.1
cctcgattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattgggcatcagagccagaaatgccctccctaggtccaggaccaaagataaaacaaacacgaggaacatgtagcgtctacacaggaaagtaaagaattatagaattaactaattctacttgaaatcaggagttttataaaacaacatttttagacgtggtcatcttttattggtttccatcatctcttccccttctctctgggaacagttacccgggtattctttgggaagctatcctttctcagctatgtggtttggcaccaccaccatcttcatgagtggaccctgtttggcttgtgtcaatcagtttatcccatccccttggccacagagccattgtgatatgaggagatactggctcttctggaaaagagaggcttttcttcatcgagagctaccagaggagatattatctgtcctctgtgtggcacataggaaaatgtgagacctagaattatagcaactttttttttctgttaaaaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacg

SEQ ID NO: 222 - DNA, 506 bp, Homo sapiens
  misc_feature: Incyte ID No: 050695.1
acctttacagtagctggtctaaaaagaagagattttatgttttattaaaacaatttctgcactattcttattaggtttcatattacttaggaaaactgaaatttaaaaggggtaaggattttacattcataaaaatttctgtatttcttttgaagtattttgattaccactctacttgtgtgaataacttttattttccagtgacctatggttttattttgatctagttttttgaaacttttgacatctttgtcatgttcccccaggatgaaaatcctaaattaagtctttttgtattaaataattagacttatttggcagattctttgtaaagtattatcaaatgataattgatactagatctttctgttacaattatgggtacattattgacataaatgttccaaaacttatataaatttacaaaaagctaatttgttatcagtcataactttgattactatattaaatcttaagttatatttgtaggggtatgttattaatgt

SEQ ID NO: 223 - DNA, 1080 bp, Homo sapiens
  misc_feature: Incyte ID No: 241234.1
gttttatgagtattaaattatgtatttctaaagacatttagaacaatacaaagaatatagtgtgggctcaataagtgacgatggtgttagttattagaaggccatcgagtgctggagaaaataattgaatatcattgatggaaataaaggaagttttccacgttaaaaagcttcggtttttggaaatgtgtgttttcagtatttctgagattaccaggtagaaattccagccagatgttggaattctgcactggcagttgggaataaagtcatgttaaaggagataagttttggagttattgtgtaaaattggtaaagcactggaatagattggtttgacagaggggaaactctttttgagataggcctatatttagggacaagagaagagacaacccaataagggttgaaagaaaccttgagagagtaagtcctatgacagaagcagggaagtttcagaatgattgcagaaagatcagccaggctcttcctgttctccatcgtggtgcaggatcaaggtgaaaaggataaccccatgcaggaattttgccatctgcaggctccgcttcaacatctgtttaggagaaagtggagacagactgacctgagtaactaaggtcttggaacagcttacaggtcagaaccaggtgttttccaaagctagatatactgttagcgcctttggcaacagaagaaatgaaaagactgttgtctgctgcacagttcgaggggccaaggcagacgaaatcctggagaatgatctaaaggtgcaggagtgtgagttaagaaaaaataacttctcagatactggaaactttggttttgggacccaggaacacattgatctgggtatcagatatgacccaagcattgatgtctacagcctggacttctatgtggtgctggaaaagccaggtttcatcattgcaggtaagaagtgcgggacaggcttcattggtgccaaatagaatcagcaaagaggaggccatgcgctggttccagcagaagtatgatgggatcatccttcctggcaaataaattctcatttctatcccaaagagccataaaaagttttcagtg

SEQ ID NO: 224 - DNA, 6176 bp, Homo sapiens
  misc_feature: Incyte ID No: 282397.77
gcgggcgccggctgagccagcggctcttgggaggctgcgtccgcgcgccggcggggcgaggcggccgggccctgcgcgtcaggcctgagacctgggaggaagctggagaaaagatgccctctgaatctttgtgtttggctgcccaggctcgcctcgactccaaatggttgaaaacagatatacagcttttgtctggtcctctgagccccagtgagagtttcctgaggtacctcacccttccacaagacaacaggcttgccattgatctgcaacaaacggcggttgttgtcatggcccatttagaccgtctggctacaccctgtagatgcctcctctgtgtagctctccgacgtctcataagagtcattttttacaggtcagaactgtagaaataatgagaaagtgacatttgtacgcatagctgatttggagaaccataataacgatggaggcttctggactgtgattgacgggaaagtgtatgatataaaggacttccagacacagtcgttaacagaaaatagtattcttgctcagtttgcaggggaagacccagtggtagctttggaagctgctttgcagtttgaagacacccgggaatccatgcacgcattttgtgttggccagtatttggagcctgaccaagaaggcgtcaccataccagatctggggagtctctcctcacctctgatagacacagagaggaatctgggcctgcttctcggattacacgcttcctatttagcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgctgttatgttgcctcttaaaacatgaagatttaggtcatgtggcattatctttagttcatgcaggtgcacttgatattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcaaacgtttgagattcctctttaatgaattgagacctgctgtttgtaatgacctctctataatgtctaagtttaaattgttaagttctttgccccattggaggaggatagctcagaagataattcgagaaccaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacagatgttcacaaatacaagtggttgaagcagaatgtgcagggtctttatccgcagtctccactcctcagtacaattgctgaatttgcccttaaagaagagccagtggatgtggaaaagagaaagtgcctactaaaacagttggagagagcagaggttcgcctggaagggatagatacaattttaaaattgtatctggtgagcaagaatttcttacttccatctgtgccgtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtatccagccggttcccctgcaaaccatcaccaatgagaacccatcgggaccgagcctggggaccatcccgcaagcccacttcctcctggtgatgctcagcatgctcaccctgcagcacagcgcaaacaaccttgacctcctgctcaattccggcacgctggccctcgctcagacggcactgcgcctgattggccccagttgtgacagcgttgaggaagatatgaatgcttctgcccaaggtgcttctgccacagttttggaagaaacaaggaaggaaacggctcctgtgcagctccctgtttcagggccagaactggctgccatgatgaagattggaacaagggtcatgagaggtgtggactggaaatggggcgatcaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcgaatgttagtggaaagcggaacgacggacaagacatcttctccaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaa

SEQ ID NO: 225 - DNA, 845 bp, Homo sapiens
  misc_feature: Incyte ID No: 984009.2
  unsure 805: a, t, c, g, or other
ggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatntaaatttcttttgctatagttatacatcaatttaaaaagc

SEQ ID NO: 226 - DNA, 2607 bp, Homo sapiens
  misc_feature: Incyte ID No: 138709.5
ggaggctgtctcctgtgtagtgtatatttatctgtaagtgagccgttggggaaggattgaatacagagacgctgtctgcttgctggccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatagataattcagtggtttttagtgatatttacaaagtggtacaatcatcatcactttctaattccagaatatt

SEQ ID NO: 227 - DNA, 3161 bp, Homo sapiens
  misc_feature: Incyte ID No: 998926.1
gctgtatcatgagcagggacactatgaggaagcccttagtgtatacaaggaagcaattcagaaaatgccaaggcagtttgccccacagagcttgtacaacatgatgggtgaagcatatatgcgtttaagcaaactccccgaagcagagcattggtatatggaatcactgagatccaagactgaccacatccctgctcatctcacctatgggaagctgctagctctaacaggtcgtaagagtgaggctgaaaagctcttcttgaaggctattgagctggatcccaccaaaggaaactgttacatgcattatggtcagtttcttctggaagaagctcgtctcatagaagcagctgagatggcaaaaaaagcagctgaactagacagcacagagtttgatgttgtcttcaatgctgcccacatgctcagacaggctagcctcaatgaagcagctgagaagtattatgatctggcagccaggctgaggcctaattatccggctgctttgatgaacctgggagccattctgcacctcaatggcagactccagaaggccgaggccaactacctgcgggccctgcagctcaagccagacgatgtcatcacacagtccaatctccgcaaactgtggaacatcatggaaaaacaaggcttaaagacttctaagacctgacacaggaggcagaagcccatcctcctccatttttaaaagctggcttccttagcagacagaacttcccagcagtgctatgacaagagctggtgttagacttcaagaccagggcagaggtcattgaggtcactaccgcttctggaagaatccactttgctgtaggcacagctgttaacaccaaaaaggggaaagccggaaacctcctggaggatgtcattgttacccatagactgtaaaccagagcacttaaaacagaaccttttggcattcttaaaaagggaggggtgggtgtgtaagtcacagattttgttcattttctgaaagctaatttcaaaattatgttgttccttaaacactgtgagaggaagtcagagtgtccattcaggcatggcaaacaattagggttaagtgttacgagggagtgataaacacgtagtgtgagtcccagtgagccgccggttgtcctaacgctgctgtcttccctgtttgggacagcctgcttatcaatttctgaagcttagaacactttttttaatactgtgtcaagatctgtcagaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcatttttaaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttcactttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaaggaatttaatataaggctatagagattaattcagtgtctaacatttgtatttatttaaatagttattgacctatgatgactttctagtcttaacattttatctttttattgttgttgttcttcctttcaaagatgtggttcttaataggttcactgaatgcacagttgaggcacttcttgtgacaccagttcccaagtagcgttaataattgggcctgtgtcataaaatgcacggatcattaataactaaatgtccctgacacttttcactacagggctggacttagtaactgaccaacttcggggggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaagcattgataagaaaaaaacaaaaaaggg

SEQ ID NO: 228 - DNA, 1521 bp, Homo sapiens
  misc_feature: Incyte ID No: 1448817CB1
cccatccagcgagcatctgcggccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaaaaaa

SEQ ID NO: 229 - protein, 259 aa, Homo sapiens
  misc_feature: Incyte ID No: 1448817CD1
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 230 - DNA, 1529 bp, Homo sapiens
  misc_feature: Incyte ID No: 332521.1
ggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctcttttgggtatctattgactctttctctctctctttctgctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctcttctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatccagagtccaggagtctgaagtggggccccaggtgatgtcattgctgctggtccccaggacccacattttaacaatcaatgttttcagatgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatggatgcgctcaaaaaaaaaaaaaaggg

SEQ ID NO: 231 - DNA, 1953 bp, Homo sapiens
  misc_feature: Incyte ID No: 245136.4
ggaaacctcgagcaacctgtgcctttaagactcagttgctatccaaacagaagtaaacagagtggaccattagcagacgccgggcgcggaggcggagccaggcgctgagggccccgcgcggcggcgggacgcccgcccgaaggggaggcggggccgctactaaagcccaagactcccggcctggggcagcctggggagggacgcgggcggggacggagctcggcgtgcttgctgctggagggtgatggccctgcaaggctgtgggctccgacctcaccgggagtcgacagcgagaggttcgccgaagagcgaggttctggggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaaaaagg

SEQ ID NO: 232 - DNA, 905 bp, Homo sapiens
  misc_feature: Incyte ID No: 237485.3
gcgaagggccggccagggtgccgcagacgcggggacgctggctcgctccctccctccctccctccgacgctatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcag

SEQ ID NO: 233 - DNA, 248 bp, Homo sapiens
  misc_feature: Incyte ID No: 350851.2
  unsure 33: a, t, c, g, or other
ggaggcatagtataatttatgagaatctgcacnacagccaaacagaacagtgccaagaacagcaggcaagcttgctttgagaatatcatttctcaccaggcagacaatcctaggagacttagatgaatctcagctcccaggaactgaataattcttaggcttacaccttattgggaacagaaggagtaaactgagttcaagggggacttaaactgctgaattcacctgtggatgtttttgagttaaaa

SEQ ID NO: 234 - DNA, 598 bp, Homo sapiens
  misc_feature: Incyte ID No: 403794.3
ttcttaagtgtaaacagggtgactttataaagatgcaaagatttatagtgtggaactctagtccaaaacagtaatcatgtgactatttaaaattaaaattatataaaatgaaaattgtagttcctgatgtgactgaggaactagcctcatttcaagggctcagtagccacgtggttagtgactaccacatcggtttggatagtggagatattaaacatttccatcactccagaaagttctgtgggacagcactgctctagaatgaagcagtgccgtaggtgtccgaagatgcaagttctgattctaccttctcccttccacacaaacacattctcattctctcttcatccaatctgattctggtgagcaaggaatcccctcagatttaagtttattactctcccaaaggactattcctaaggttgtaggctcatagtaaataatgcacatagcttcaagaattctcaagaacccttgtagctgggaactgttttctagataagatcactaccttcaattgtttacaaggtggatatgggcaggcaacagatactttattttatattaagaaaaggtaggggttaaaaataaggcattg

SEQ ID NO: 235 - DNA, 1568 bp, Homo sapiens
  misc_feature: Incyte ID No: 227489.1
gaggcaggagtgggagtgatcccagaattaagaggagaatggagttaattccatggaagaattcattaaagctgaaacaaggtatattaatactttcgtacctatgctctcagtcagagatgtgactgtctttaaagcaaagcacagaaaaccaagaaatcttaccaaccagatctcttacatgactacacctgacagatgatgcttagtattaactaggtacctgatgttaaaagatgtgggcagagagggcctaggatgattacgaatttgtagcctttttatgtaagaaatacctgaaagaacagaagggctttgtcctggaggagagaagactgtggtcatgagtgacatccttcatgacaccaggagcattctcaagcattttctcgtaagctagcacgcactgcctttcactggctcattagtcctcacagcagcactctaaggtaggcgtaggatccttatttcacagccagtgaagctgaggcttagagagggacaatgacttgcccgcagttgactcaatgatagagaccagtctctaagccaggtctaagcccgtgtctctgcctgttagacaaatctgattggccttgttctctgtgagtttaaggaacagaacgaggataactgggcagaaattaatagaaagacagattttgggctccgttatatataggaatcactaacaagcccgtccaaggtgggaacaaactgcttccagagtagttgagtttctttgtcgctggaggtattcaaacaaatgccagaaaatcattgggtgggcatattatagaaaattttcaagcattggcaagagatcgaaccagactttccaatcctataattgtataatctgcagttcattagactcatcagggaatattttttaccaggctctaattgggaggaaatagccatcatctaaaaaaacaaaattttagctttcatagtaatctatgttagtaattcattttaaataaaatagatgtttcttagcatatgcaaaacataaaagcagagaaaatgtaattgtgtaaaggcagagttaaatatttaaaatttaaaagcacagaaacttaatttgattgaatcatcaactcagtcctcctagttattcatagattgtgagggaaaggggttttttctacgttctcaaacatggatgtgagggccatctggctgcaacacctgtcaccccattgatcggcagagttgattccgctgatctggctggctacgcaggtgtccccttcctccttcactgctccatgtgcatccctcctgaaccagcagctgggtcaaagaggacgaccatcccgtagaggagggccgtccctcagtcaagggcatacgagtagctgccctcccctgctagaacctccagataagctctcaagttctcagacacctttgcaattggaaagactaattctaaaagaaaggaaatgtttccatctctacagaaaagccaaagctgtttaaaaattttttttcaagtgaatatagggcacttaatgggaaactttctaacttactgggtataactgtgtctccaacaaacc

SEQ ID NO: 236 - DNA, 299 bp, Homo sapiens
  misc_feature: Incyte ID No: 268110.1
  unsure 280: a, t, c, g, or other
ggaatcacgagaacatgtttaatgggacttgatttgggttttgtaagggtaactttcttttttatgtttatacgcccttctaagaaagatttgagctacttataaaagtacatggattataaaaattatgaagtaattttgaaagaaggaaaattaagtaggaagataggttacacagaagtgcatattatacagtccttcacttagagttgagtcacgaatttggttctgagctcaaaaaggataagtacccttttgataggcaaaaagaaggggaganagagggagagagcaaaggg

SEQ ID NO: 237 - DNA, 592 bp, Homo sapiens
  misc_feature: Incyte ID No: 268244.1
ggagggcaattaggaaaatatgtctagagaggctccttagcaggatgatgacgaaaagaaggttgagaaacaccaggttacactaacaattgggagccccaccttaaactcctggcttgccccagtgttctctgtttcaagtctccaggcctttgcttatgctgttccttctgccagaatgcctttccctacacacttcctgaataaccccctagaggtgttttaaaactcaggtcactcctcgctacctgcaggaatgcttccctggcctgcctcattcaggggacatccccttgcactgtagctccatagccccatgcagtcacaagagcattcattcactcactcattcattcattcatttgcaaatgattactcaatgtctaccacgccatgcaccgtgctagacgctaaggatgcaatggaggaaaaacaaaacaatgacaacactaacaacaaaaatacagcccttgccctaccagagcttcagtatgtatggaggcatagaaagaaagccaagttcaacaattgaaccaatcactacaggcagccctggccatcccgatgttcattatctgattcaataactact

SEQ ID NO: 238 - DNA, 177 bp, Homo sapiens
  misc_feature: Incyte ID No: 268253.1
ttagtgggaatataagttatagtataatggatgaattaatacgacttgaggaagttcagagtcagcaatggtaagaagggaaataaaatgttatctataagaagtagtatgaccaaagtaaggctttcgagaaagtgagagagttgagcacattagaagggaaagatgtttataatg

SEQ ID NO: 239 - DNA, 424 bp, Homo sapiens
  misc_feature: Incyte ID No: 270049.1
  unsure 418, 421: a, t, c, g, or other
agagccagccaccttccccgaaagcagctgcaaactctcccggaggcagaacagtggggcttggaacacggaaaactcaccactcctcggcgctgggaaatgggagctgtaaagtgctttgacctctttttcaaaccagatcagctcctgcgttgctcctctccagtgaccgcaagtttcaactgggtgaggagctggtgtccctgctcggcctcgcccagcggagtcctggcctgctctcgtacgcccggctccccgcggctcctctgagcttcccaaaggcctcccagccctgccagccctcggcatgtcccttttagactccatgggattatccgtgggaagctttctccatgtttccccccgcctttttcctgtctttattgcgaaagagagagaaaaggagaggagagaagcnganaga

SEQ ID NO: 240 - DNA, 1522 bp, Homo sapiens
  misc_feature: Incyte ID No: 997142.1
gatgttcattattcagatttagctttcagtacatacgtgtgtcatcatttgcaaagtagttttctttcttatcttcctggttctctaattccctcaccccccttttagcctcagtactactgtacattttctagtaaacttaaggaaagaggatactaaactttattttcttacctctgtcttgctgcacagattttatctgctaatccagaagaacattctgcccctggatagtcagaattacgtgttttgtggattggggagggaggggaggaaaaggaggaggcatcagagctgcctttctatgaagagtttccggcatctggaagctcttttgcccaagcttataggagaatggaaatcagctacctctgttcagggcggtgtattttagaaaaagattgagtggggtgattgtttccagtctggctgtaggctctcaatcttaaagctgtgtaagattaattttttaaaatgcaaatatataaacctttttgcaactggtttgatttaaatgtagggcttaatggcacatgtaaagcaaataaagtatgttcactacttcagatgcaaatcctaaaataggaagaataagggcttattggctataagaagaaatagggttttaccgtgaccacagtttttgactcaatgagtgatatagacaggtattaaatatgttgctgaggtaaaggcaggaaggaaagaaaatgcacaaatacaagaatgatgtttttttctttcaacattttattttttagtttctgaaatacaaatcagaatacattttgttacataatcattttaacaagcttgacattttttcaatgtaagctgactcgatataggtactttaaaacttcctttttaaaaaaccatacgttttatcttggcaaatagctcatcaaaaaaaaaatacacgtgtacatgggaagttgtttttcattattttctagcacaacccccaacttaaaatttggtccactgaaatacgtaaatattcctcctatcacaaaaataaaatctcatggttggggaaaaaaacaactgtctggcataggcctgagtgagcttgagaaacaagttaggatgtttaactgtatggaggaacatcacggagtccacctagaaccatctagcagaacgactagcctgttgctattggagctattctatttcagagactgatacaaggtgcatgctcggaggttgctgaagattaacaacagccacggaatcacttactcagaattagccgaaattcagtatacaagaatatgtgacaacagtagaacagtcagcagttactcagtgcccagaaagcaagccgtaagtttagaataagaacctcagcaggaacaatagtcaacatgtttataagactttgaaggtgagaaaacatttgtagatgatgtcctgtgcccaagtatgttagtttccaggacactggggacagcatcacaacatagaaagtaagaagaaatccaagctgtttaaccttctaacattctcttgagtacta

SEQ ID NO: 241 - DNA, 2966 bp, Homo sapiens
  misc_feature: Incyte ID No: 997080.1
gcagatcagtgtgtgagggaactgccatcatgaggtctgacaagtcagctttggtatttctgctcctgcagctcttctgtgttggctgtggattctgtgggaaagtcctggtgtggccctgtgacatgagccattggcttaatgtcaaggtcattctagaagagctcatagtgagaggccatgaggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctgacctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcctttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagatatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactagtaagcaaatatgttaatcttctcatttttttactgtcatataatcttagtgatatgcctattaatagttttaaataaataaattggcttatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaagttt

SEQ ID NO: 242 - DNA, 273 bp, Homo sapiens
  misc_feature: Incyte ID No: 243369.1
  unsure 8, 102, 109, 122, 127, 130, 157, 205, 212, 229, 254, 256, 262, 268: a, t, c, g, or other
cgtcagtngcctgtacctgggggagcttgtcaggcttatcttgctgaagatggccaaggctggcctcctgtttggtggtgagaaatcttctgctctccacantaagggnaagatcgaaacanggcangtngctgccatggagaagtataaagaaggnctttctaatacaagagagatcctggtggacctgggtctggaaccgtcngaggctnactgcattgccgtccanaatgtctgtaccatcgtctccttcngntcggcnaatctntgtgc

SEQ ID NO: 243 - DNA, 7212 bp, Homo sapiens
  misc_feature: Incyte ID No: 379571.7
  unsure 5671, 5695, 5709, 5711: a, t, c, g, or other
gcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccacacaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatccccataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtntctgtgtctgtgtgtgtgtgtgtntgtgtgtgtgtgtncncgcgcgcggtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttccaaaaaaaaaaaaaagg

SEQ ID NO: 244 - DNA, 7718 bp, Homo sapiens
  misc_feature: Incyte ID No: 322303.15
  unsure 6339-6362, 6967-7026: a, t, c, g, or other
gcggacactcctctcggctcctccccggcagcggcggcggctcggagcgggctccggggctcgggtgcagcggccagcgggcctggcggcgaggattacccggggaagtggttgtctcctggctggagccgcgagacgggcgctcagggcgcggggccggcggcggcgaacgagaggacggactctggcggccgggtcgttggccgggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaacttattttagagaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcccgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttggactaacaagaatgtaactccagatagagaaatagtgacaagtgaagaacactactgctaaatcctcatgttactcagggttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccaggggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagacctttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagagttttctccatatcaaaacgagggctgatggaggaaaaaggtcaataaggtcaagggaagaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttgttcctcttctttacacatacgcaaaccacctgtgacagctggcaattttataaatcaggtaactggaaggaggttaaactcagaaaaaagaagacctcagtcaannnnnnnnnnnnnnnnnnnnnnnnccaaatcagataatagcccagcaaatagtgataacaaataaaaccttagctgttcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtgnnnnnnnnnnnnnnnnnnnnnnnnnnnnnnnnnnnnnnnnnnnnnnnnnnnnnnnnnnnnatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataatatacttaacaatatttctcaattgggatttgtaatcgtaccaacttaattgataaacttggcaactgcttttatgttccgtctccttccataaattcttcacaaacactaattcaacaaagaaaaagctctaattttcattggaaataactttatatacttgtttagagcagagaaaaattaagaaaaactttgaaattgtctcaaaaaattgctaaatattttcaatggaaaactaaatgttagtttagctgattgtatggggtttctgaacctttcactttttgtttgttttacctaatttcacaactgtgtaaattgcaaataattcctgtccatgaaaatgcaaattatccagtgtagatatatttgaccatcaccctatggatattggctagttttgcctttattaagcaaattcatttcagcatgaatgtctgcctatatattctctgctctttgtattctcctttgaacccgttaaaacatcctgtggcactcttatttattaatcagttaaataaaatcatgaacatata

SEQ ID NO: 245 - DNA, 5807 bp, Homo sapiens
  misc_feature: Incyte ID No: 232935.20
  unsure 3443, 5203-5225, 5230-5232, 5234, 5238, 5244, 5246: a, t, c, g, or other
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaagccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaacggttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcgaccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagtgggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttcnttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggagggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatggatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagannnnnnnnnnnnnnnnnnnnnnnaaaannngnaacngaaaananaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagct

SEQ ID NO: 246 - DNA, 2876 bp, Homo sapiens
  misc_feature: Incyte ID No: 1445507CB1
gaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaagggaagaaagaagatcttcaggaagtagatggagaaattgaagctgtcctacaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaaaaaaaaaaaaaaa

SEQ ID NO: 247 - protein, 856 aa, Homo sapiens
  misc_feature: Incyte ID No: 1445507CD1
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKGKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 248 - DNA, 3710 bp, Homo sapiens
  misc_feature: Incyte ID No: 069812.3
  unsure 912, 2748: a, t, c, g, or other
gcgagcgccgaggggacaggccgagcgcggggcgccggaggcaggtgagcgctgcggacacgggggagcgcgcccgcccgggcctcagtttacccggtggcgatgggacgctggggcttctggttcaggacaccgggactgaacgcggcgtcgcagtggcggcggtggcacttgtgagggcgggccgggccgagggcgctggggcaatgggtgctgtgggtgcctgtgtcgagtccccacctctcctggacgggtcctgctgcagcccggcctgcccccgtcggtcctgggcggctggcctggcgagcaaggatctttttaagccagcgatgggtgactcacctgccccgttcctgcccactcccagctctggggcttggttgggggcaatccctgcgtcctggagagcgctggtggtagggaggcttctcccggttctgtgagcagcaggaccctcccgtagggcctgaccgtggagtgtagcacttgcacacccactcgctgtgggccggagacaggaggcacttcttgggtgtcggagcccagaaggaaaccagtggccggggaagcaccagctgggtcagtctccaggtgtgggaccaggcactggtctcagaccggggccacactgaggtctgcccttctcccgctggccgccacccaagacaccatgagccagtccggggccgtgagctgctgcccgggtgccaccaatggcagcctgggccggtccgacggtgtggccaagatgagcccccaggacccggttggaccggaggaagaagtattccaactccaacgtcatcatgcacgagaccctcgcgagtaccacgtccagcacctggccacattcatcaatggacaagagcgaagccatcacgtctgtggacagacgccatccccgagaagcgntggtgcagctgagctccaagagagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcgggagcagagcaagccggatgtccacttcttccactgcgatgaggtggaggcagagctggtgcacgaggacatcgagagcgcgttggccgactgccggcttgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcaatccgaggctttcaagcagctgaaccagcggaaaaaggggaagaagaaggggcaagaaggcgccagcagagggcgtcctcacactgcgggcacggccccccctctgagggcgagttcattcgactgcttccagaaaatcaagctggcgattaacttgctggcaaagctgcagaagcacatccagaaccccagcgccgcggaacttcgtgcacttcctcttcgggcctctggacctgatcgtcaacacctgcagtggcccagacatcgcacgctctcgtctcctgcccactgctctcccgagatgccgtggacttcctgcgcggccacctggtccctaaggagatgtcgctgtggggagtcactgggagagagctggatgcggccccgttccgagtggccgcgggatccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgcccgtaccaccagtcagctccccacatactcacaggggctaccagtcctacaccagccatgtccaagtacgtcaagatcctgtatgtacttcacagcccgaaatgccttagagtctatcggtgctcaaggatgaggtcctagaggtgcctgggaggacggccggcagtggtggaagctgctgcagccgcagcgggcccaagggcccgggcgcgtacagtgccctgctaacatcctagtgcgatggcgctgtaccggtaggacgccaggcgccccgttcagagcaggccggtcagaatgtactggggccaccgccagccacgacccacaagctacccccaagcttcccggggaacaaagacgagcttcatgcagcacatgtgacgaggtcaacgacgagctcatccggaaaatcagcaacatcaggggcgcagcaacagaggcacttccgcggtggagcgcagccagcccgtgagccagccgctcacctacgagtcgggttccggacgaggtccgcgccttgcttggaagccaaggcctttcagcccgcggatcgtggagaaccctgggcttccttgaccgggccgcgagctcttctcccttcaacaaggaggagctgaagaaagtgtgcggcgacccnaggcgtccgcgtgtacagccagctcacccatgcacgaaggccttcctggagaagcagcaaagtgggtcggaggctggaagaaacctcatgaaacaagtttcatctccatgaatcagaggaggggggaggacagctatggctcagctgccttgcggctggcgcctgcgaagggggaagcccacccacaatgcatggagtattatttttagtatgtgtatgtatttcgtatcaagtgacacggagggggtgtggtgcttggctagaggtcccctgccccttgtctggaggcacaacgcccatcctttaggccaaacagtacccaatggcctcaggccaaaacaaaggactaatcttcagccaaaacctgctgcttggtggtgccagccccttggtggtgccaagccccttgtccaccttctcttgaggccaacagaacttccctggggcttggggcgctctttctcttggcctcgccctgttgcgacctggggggttcctgggcgccctgctgatgctccctccatcccgcactccacttctacatccatccacaccccagggtgtagctggagctccaggctggccaggctgaacctcgcacacacgtgagagttctgctccctgtaggggggcccgggaggggctccatgtcaggtaggccgtgggtgccattcgggtggaaatgtgggtggtataccgacacactacttctactctgcaagggccgacatacgcagggtacaccgtgccggcttctagacactcccagacgcccacatcttacaggcccaaggactggagctttctctggccaagtttcaggcccaatgatccccgcatgggtgttgggggtgctggtgtgtcttggtgcctggacttgagtctcaccctacagatgagaggtggctgaggcaccagggctaagcaattaaaccagttaagtctcaaaaaaaaaaaaaagg

SEQ ID NO: 249 - DNA, 715 bp, Homo sapiens
  misc_feature: Incyte ID No: 444648.12
ccggaaccccaaggggcgggtgtagcaggcaatcttggcgaaactgggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgaaaaaaaaaaaaaaagg

SEQ ID NO: 250 - DNA, 492 bp, Homo sapiens
  misc_feature: Incyte ID No: 025194.1
aggacccagacatctgggactgtggttctctcgcggcgcgaccgcctcagtcacttcgcccagagacccggacctggtccgctggggagcaggcggccataaaccccctctctcccggttccctgacgccgcggcaggagctgttacaaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttgggactgc

SEQ ID NO: 251 - DNA, 2278 bp, Homo sapiens
  misc_feature: Incyte ID No: 1518310CB1
ggctcctctccccgactcggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctatagtaacgaacagaaaa

SEQ ID NO: 252 - protein, 226 aa, Homo sapiens
  misc_feature: Incyte ID No: 1518310CD1
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 253 - DNA, 1956 bp, Homo sapiens
  misc_feature: Incyte ID No: 241335.1
gacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaataggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtgaaaaaaaa

SEQ ID NO: 254 - DNA, 1208 bp, Homo sapiens
  misc_feature: Incyte ID No: 022651.1
cggcccggcaggttcaggctctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggcacaaggcactgaacctggagcgcctgaggggaactgacgcttgcttggcacctttgggaagactgcgaaccagctcaggtcccaggggagcgtgtccgtgtctttttcggccgcattgatgcacccgcccaagtcatttcctcagtcttctgcttcctagaagcaaaacaaggaataacattatgatacctttaaaaagctgaggcgtgaaactgctcctgcaacttggaagcgcagggcacttgaactttattccctaaatgctcgaaaaagaaatctttctggtggcagcttgctactcaagatgagtgactctgaccacaaccggctgaaattaacttgaggccctagatcatttgctatgacactaattccacgttgttcctcaattatgtctccattacctcaaaggctgaagtcgtcctggctgcacggagcagcccagtcttgtctctgtaaataccgcagatttgaaaaatagtcctattggaacccgtcagagggatgtaatacaagggactgtgatggctcttgaacggagccagagactcttcctgaaggactggactacctccccgcctaggaaggttgggtaacccaaagttgccacatttctgggctgcacaccaaggagaggccccggccactccacacaggaaatgcacgtctgggcacctggagccgcaggacctgagccactaactgtccctggatcccttctgcttcagaggcaaggaagactgccggagtcattgcttgcctgctggcttcaccagcgctttctgtttttccagttctcctcaccactcttcctggcgcctttctctgcctcccgcacccctgcctcctctaaaaccccca

SEQ ID NO: 255 - DNA, 2320 bp, Homo sapiens
  misc_feature: Incyte ID No: 025911.1
attctttcctcattgcatattacaccaaacgtttgagggaaaaatcctcattcgtaaaggattttggatttataatctaaaactcaacaataaagaaataatattccaagtctctggtttcctaagatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctccataaagtagaactgatacaaattttggttggatatatagagaattttataaatgtattgcctagaatttctgggtggagacccaactacaatgacattgtctgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaattaa

SEQ ID NO: 256 - DNA, 375 bp, Homo sapiens
  misc_feature: Incyte ID No: 336470.1
  unsure 314, 326, 347, 355: a, t, c, g, or other
gcccattacagctgattaaaatctaataaatataaaaggaatgataacatcagaaaatcaccataactgtcatagctacaattaattgaggcaagagtcatcaagggatgcccaaattttgggacaataataacctccttacttggaaaatgaaatggtaacttcacagtggagaaagcaaatggacactaagttacccaagtggtaaaagttaacaatcctaataataaaacaaaatgacataatcacttatgtagtattgatgccaaaaaatgtattacctgaatctagtcatgaaggaactccagatcagnccagattgaggnatgctgtacaaatcaagtggnctgtactnttttaaaatgctaataacat

SEQ ID NO: 257 - DNA, 2358 bp, Homo sapiens
  misc_feature: Incyte ID No: 978673.2
gcggtgagaaatggacagcccgcattgaccgaagctttgcgcatgcgttttactgctgggtgaagccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcagcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctcaggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttctatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctg

SEQ ID NO: 258 - DNA, 865 bp, Homo sapiens
  misc_feature: Incyte ID No: 054242.1
ccgcacggtgacgttgccgtgtgagcccagcagtcgcgggcaacagggagatttttcaagggggaaatgacgattagaagagagaatcatctaaatatcaaagtgacacatggggagacttggaaaaaatatttaagctaatgaaaagcaaataaagaagcagacacttaggctgggaaattaaatattatgtttaaaaatggtgcttttgtccgggcttgaagatttccgattcatgtacacataataaacactcaggtttgtcatctggaggtgcaaatctgaaagatattccgacaaatgaagtgctggcagagagaggaataaagagatcggtgcctgtcaggggtcaggcagcctgagattgcttctagagatcttttgaaaatttcacacgattgaaggcttaggggcttcactgcgttcgcatttcaaactcagatcagtgggatcacaatcaaaaatagaggtctgaaaaggggagaggcattcagccgctgcttttgatgcgctatctatattagaccgatgcgccgttcttaatcaggcctagtccgatttcctttcctctctcggtcggtcctctgaaactttataactatatgtaacaccgttgtcagtggggacataatcttctcagggttcttattagaagaaatttccatcctctcccgttctagattaggcgcagtggagtccgctccatcaatgaagggactaaggtttcgtggacaataatgtggcaattgttgatggtttgtgacccataaaatgtggaggtgactgttctggctttggtatgtaattatgcaaaacactttccataaagacttgccattcgatctaatggcagtcctgcggtcta

SEQ ID NO: 259 - DNA, 3482 bp, Homo sapiens
  misc_feature: Incyte ID No: 1823159CB1
gggatagggaccgtcatttgcctagaagattttgactctggattgggcagcctgccccaatttgaatcctggacctaatattatctgtgtgactttaggcaagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaaaaaaaaaaa

SEQ ID NO: 260 - protein, 603 aa, Homo sapiens
  misc_feature: Incyte ID No: 1823159CD1
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 261 - DNA, 450 bp, Homo sapiens
  misc_feature: Incyte ID No: 020602.1
aggcgtgagccactgcacccggcctagtacacagtttttaactttgataaacattgccaaattcctctccaggaaggctgtattaatttgtattccctctgagaaagtataagactaaattaccccctctcttgcctaattggctatcatcattttttgtattttctgggagtaagttcttagaaagttttgtaagggacacttacattaaaccaggacatctccctggtaacaataaaagcatggagaaaggaccagggaaggagaaaacaggtataaagttcccagagaccccactaggttttctacctgtgcgatcctagattaaaaccacttgttttgatttcaggaaattagggacaataaaaatctcagcctgaactggaccttgtagaaattatccctgcttgagcaataagcactctaaattcagtctgtttagaaagattc

SEQ ID NO: 262 - DNA, 2002 bp, Homo sapiens
  misc_feature: Incyte ID No: 1090531.28
  unsure 1943, 1952, 1957, 1961-1963, 1968, 1973, 1977, 1980, 1983, 1988, 1990,1994: a, t, c, g, or other
gctgtctggaaagattagataaggaggaggaagggagctagatagaagtggggcaggtgactatcaaggagcctgactcaaaacctaccaccttggccaccatcagagcaccatgggagggggaatgacagactgggggaatgacagactggggaaatccccgagggaccctgaacaaccctccccccgcccccattcagctgtggatgagaaaactgtccctggggcatggaggagaaactgacccgcccaggtcacacaagttaatggaacagcaagttccagatcccaggtcttctggctcccagccccagacactggctgtgggtggaggattacccaggtgccaaggcaagagactgaaggcacaaactgtttcagtataataaaaaaaatagaataagaatagtcataatacaaattagatatagaagatgatcatgggcaattagcaatcactattaatctttacttgcaatattactctttgttgcattactaatataacctaggaataaccggtgggtatagggtcaggtgctgaagggacattgtgagaagtgacgctggaagggcaagaggtgagccctctgtcacgcccacataagggccgcttgagggctccttggtcaagtggttaacgccagtgtctgggaatgcacccgttaattagcagaccgcgaaagggagtctcctttccttggaagagttggggaacactctgctccaccagcttcttgtggaaggctggatattatccaggcctgcgcgcagtcatccggaggcttaaacccttccctgtggtgctgtgcttcaatggtcccactccttgtccactttcatgctcctcccgtactcctggttcctctttgaagagcgcagtagatagcggtagaagaaatagtgaaagtcttaaagtcttcgatctttcttacaagtgcagagaagaaaacgctgacatatgctgccttccctctctgcttcggctacctaaaagggaagggccgcctatcctgtaatcacatgacttgcttcaccttgtcaatcacttagaagattcaccctccttaccctgccccctttgccttgaataccataagtagcagcgcggtcaggcattcagggccactactggtctccgcgtctaggtggtagtggtcccccgggcccagctgtcttttcttctatctctgtcttgtgtcttcatttctaccatctctcatctccgcacaggaggagaaaaacccacagacctagtagggctggacatctacagtgccacccctgaaaagcactgctctgcatcacttaccaggctgggcaaaggcctccatgcctgctacctaagctggcctcagctcgtccagcctggcctgggcctggccagtgggaggtgctgctgagaagccagagccctgggctgtcctggacggccagcagggggcttgctggcatgaacccttcacagctgagcctgtcagggtgagggcgtgcacaaaaaagtatccacagatgttgtgcagcagaaataaagaaacattctaaccttttaagacaaaaagacagtatcgcttcttggccttttggccaagatcaagtgtagataaaaacattgtaagtcatgattcccttggaatacgatcagtattgtgagggaagagaggcaaacccccagcccatcaccacacactgcagctcacacacttcaggttttgtgctcccagacaatgcctgtcctcatgagagcactgttgtctgcgccgggaaatcatcctctgacctgttcacaagtcttctagatgaagattttcagcgggtttggatctatttaaaaagcggtaactgcaaagaggcacctaatccacttgatttgcctgtttttgagaggtactcctggcagttatgaaggtcattaaaagtatcagaataaattgaactttttnttttttttngaaangggnnnttgcngggtnggcncantgnaaccncnatcncccaaatt

SEQ ID NO: 263 - DNA, 996 bp, Homo sapiens
  misc_feature: Incyte ID No: 399872.1
acagaaaggaatattacagtgtgaaagcatttatttatttgtttgacaacagctacaattgaaatacagcaattctgaaggtctttaaatgggttgcactttgccctgttaactcactatttcctgattggcaataattttacttggtaatgctctgtattatggtaaaagctaacaataataatttatcgagtatattctttgtagcaggcacagttatgagtgctatgtgaatacatttaatcttcacagcaactttgaagtaggtactattactgtgcatattttgaagatgggaaaactgaggcagacagtttgcctctggagccctcactcttaaactcttatgatatataccagaaactgtgacatagcccaggtgccaaatctggccctccacctgcttttgtaaataaagttttattggaatacacccatgcccactcatttacacattgtctatagccatttcggtgctatagcttcagggtggagtagttgctacagagaccacgtggcccacaaacccttaaaacacctactgtttggcactttgcagaaaaagtttgctaacccctgatgtcaactttaaacttcacaaaaagactggagtttaaagggaaagaaataatatcttataataaaaatgccttatgtttggtatttactgtggatttgtacatatttatcttacttaattctcatagcaatcctgtgaagtaagtagtctttttatttccattttagaaatgaagaatcaggagttcagagggattaaatgacttacactctaggctgaagagcaaactccatgagtgtagggatcatgtgtcttcatcatcatgtccctgtcacctaccacgatgctagcacagggtggacactcagaaaatacttgctaaatgaatgacagttacaaaggtcacccagctagagaatccaggtcttctcctcttccagggttctttctcctgactccacagctgtctgacagtt

SEQ ID NO: 264 - DNA, 691 bp, Homo sapiens
  misc_feature: Incyte ID No: 229176.4
  unsure 554, 589, 618, 625, 630, 632, 642, 647, 654, 667, 679, 683: a, t, c, g, or other
actggtgtgtagttcttaaagagcagttatcactgttccctgccttgtggtgtcatcggatgtgtccccctcgctccaactgagctgtacagcgagtgacccaggctgggactgacccctgctgagaagtaccaggcggtcttgtccctctgcctgaagcccagacagtgctctcaagcataactgatgtctcgctcatcagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcgtgcctggcttgtcctacagaatgggagggcctgtcctcacagacctgcacgtctcagcctctggggcagggtgtgcttcccttcaaggggtttagggatcaggactctcttggagacattccttggtgttttctgcaggtntttgaaggaaatcgcccaaccaactctattgtgtncaccaagctcacaccattcatgcttgganccttggncggtnantgagtagggnaaacntcctggnttggggtaggttnaaatgggcttgngganccctgatg

SEQ ID NO: 265 - DNA, 3616 bp, Homo sapiens
  misc_feature: Incyte ID No: 229176.5
aggatctggccgtggtatgaggatcgagtctgtcagtgtctgaggaggtggatctggatctgtcagtatctgaggaggtaggatctggccttggtttgaggaactgggtcgttcaatatctgaggaggtacgaatctgatacaggtatgaagatctggttctctccatgtctggaggtaggatctggtacaagtgtgaggatctgggtctgtttatatctgaggaggtaggatctgtacaggtgtgaggatctgggtctctctgtttctgagcaggtaggatctggtacaagtgtaaggatctgggtctgtccatgtctgaggaggtaggatctggagcaggtataaggatctgggtctttcaatgtctgagaaggtaggatctggccatggtatgaggatctgagtctttcaatatctgaggagataggaatatagtacaggtgtgaggatctgggtctctccatgttggaagaggtaggaatctcttacagacatgaagatctgcgtctgtcaatgtgtgaagaggtaagacctggccctggtatgaagatctgtgtctccccatgtctgagaaggtaggatctggatctgcctgtgtctgaggaggtaggatctggcatgagtatgaggatctgcgtctgttcatgtctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatcttcatgtctctgtatctgaggaggtaggatctgatacaggtattaggatctgggtctatgtctgaggaggtagcatctgatacaggtatgaagacctgggtctgaccatgtctgaagtggttggatctggccctggtatgaggatctgggtttgtcagtatttgaggaggtaggatctgtccctggtaggagggtctgtgtcttctagtgtctgaaaaagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgatttttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagagcgagactccatcccccaccgccccgcaaaaaaaaaggaaaagagaaagatttattttttgaacctctggtttgtgccaggtaccatattaggccctaaagataccagagggaacaaaacagacctcatgaaactgatgttttagtgggggcagacaaatagtaaataagtaaacatccatgagatccattatgatgagtgttatgagaagaataaagactggaaggaaaatgggagaatgttggggagggttagtttgggataaggaaggtgaggacagggcaggccccaactgacaaggaaacgtttgaataaagagcctaaggaggcaaggcggggagccg

SEQ ID NO: 266 - DNA, 1448 bp, Homo sapiens
  misc_feature: Incyte ID No: 124600CB1
  unsure 1164: a, t, c, g, or other
gcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagaatgaagttttccttcatgcacttggtgataaacgtcttctaaattttcagttaagtatatggataaaaagttatgaactattaaaaatgtgatgtggaccaaaggctaggttgtaatcttgatagtctaaaaatgatcacaacaaatgattttcaaggaatattcactattctgccttccagaaagtgtatttatatctgggcttcaaaaatatcaatgttcttcagaacatcactttaanggagatactcgactcgctatctaactcaccccagatgttacacactcacattcacgttcatactttcaaagaggaaagtcatcaacaatgacacttttccacactaatcatctccattttctcccactcccactggacaactcaggcttcaagggttcttaggtcgatttttcgcggcaggacagactccttcaaggccccatatccggctaactctcgttttgcaaatcagaacacactcatcacatcggccaaaaccaaccccttctgaaacgacacttcct

SEQ ID NO: 267 - protein, 266 aa, Homo sapiens [sequence omitted]

SEQ ID NO: 268 - DNA, 6617 bp, Homo sapiens
  misc_feature: Incyte ID No: 994387.65
aagacttagatcactgtgagatgaaagaagagcctactagatgagaagaagtgggaggatgaaggaactgaaaaagaaaactgggcaatattagagaaaattaggaagactgaaaggcaaggccatttaaatgtgttgaccctgatagtcctttgcacagtgatcttcagatcttaaaagaaaaagaagagataggagacattttgcttatgttttaaggtatgtatcgggtagaggagcattatatatggaacctctcacaaaacagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggaacaacgagaacaagagcacactgcagttggagcagcaagtaaaggagctgaagaagtcaggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagcccccagcaggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggcaacgtgaacaggaggataggctacatgaacaggaggagaggctacgtgaacaggaggagaggctgtgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgtttcagtgccaagaatgagtgctgtactacagtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacagaaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgatggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtattgtacctagcggaggttgcagctggcatatgaggaagaggttcttataattattcgcggctgggaaacttatttattgctagcataggagcgaggaagcaggcggggatggggtcatggctgcctggtgatgggactcctgttttttgttttttgttttttgcttttgattttggaataaatggatttagccatactgctcggcctggtatgttcccatttccctcactgggtcctgcagtttgtcccactgaatgaggagccccagagtgtctcagcatgtccagctgggctgttggggaccttccaggcctgttacctgtatgctgcctggtgacacctggtggatttcatggggactgccatggcgcctacggagtacactctggccctgacagccaactggttgagaagcctgatctagctgtggcagggaagacagataccagtgcccaagggcactgacttccatccaccccaggtgtcttccgttctgttcccctgcctccctctcctgtctgcaccgggtggcctgtctgtccctccagagtgccggctgtcccgcaggttccctccaggctgagttcagggccctgtcccctagtggccag

SEQ ID NO: 269 - DNA, 736 bp, Homo sapiens
  misc_feature: Incyte ID No: 201462.7
gtgagtttgtagtataggaatatttgtatcatgatggagtttaatgtgaaagttatagacagtgcttatgcatctgtattccttaagcatttgtgtaaaattacttttttttgcatgctattattgttctgataaaatgctaataagacaaatgtgaaaaccaactcagtttctagatggaaaacacatggaaggatagacactgctaagatgatgatttatctctttgggatcagaaaaattaatatatatgattttatgccaaaactggttctgttttacagaagttttatttttcatcagacataaagattgatctgttttcttcatcagttagaaaatgtgtagttctgtctgccacaatttctagtatgtagatttcccatggatctttgcttttataattttatgtcagtttgtggttacttaattgccataatcttttgtcataactttacaaaaacaaattcagatgaagcttaatgacaatttgtgaccagttataaaattatggctttgaattttcttaatcggtaaattttacacatgtaaatttttattctttagctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggagga

SEQ ID NO: 270 - DNA, 886 bp, Homo sapiens
  misc_feature: Incyte ID No: 991497.1
gaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattctaaaaaaa

SEQ ID NO: 271 - DNA, 1596 bp, Homo sapiens
  misc_feature: Incyte ID No: 347444.1
  unsure 676, 933, 952: a, t, c, g, or other
atccagaaataggccctggctgcaggcacagcaagtaaacaaacgtcctgccagctgtggcgaggtgcacccttccaagcagacctgcccaccaggaccattgctggaagacggaagccctggagcctctccctggccctgttttggaaggagtcctccaaggctgagaacagccccagccacatgaagcaggcaaggttttcttgaaaattctaaattatcccaaccagctttggccctacgtcagttataagactcaagataggatactgccattgggatgttaggtttgtgcgagggctgtttacttgagcccagaaataggttatttaaggcagagattcattcatctaaccaatatttgttgagcccctgccatgttccaggcatggtgcatggtgttaaataaagcagaacggcatcttcccacatagaatgatggaggggggaatagagcctacctcattaattctgtggaagttgtaagcacaaggtgctttgagagcacatgggaaggagatatgagagccctagaccagttggagtggggtaggagagaggccgtgttaggggcgctgagtccatagacaatgaataggagtgagaggaaatagaagagtaagagcatggggaccacgaggagtcctggaagaggaaaacagcatgtgcaaagccnctaaaagcaaaagggaacttggaggatggaaggtagttcagtgtagctggagcacaaagaacaaaggagggatagacgagaggtgagggtggaaattactaaacaaggccaggtgtgaaggattttataaaccatgttaaggagtttggagtttattgtgggagaacagggagctaatggctgattttaagaggggcagtgacaagatgagatttacatctagaaggttatggctgccatgggtttgccacaatgtnaaagtttgaattgaagagngttggaccaacgttaattcacacattggcagccagatacatgtctatgtgaaatggtttttctttgtttttattttctacttcaatttttcttgttattttttcactattacagaacaagttggaatcatgtatggcagattgtattttccaaagatggccaaatcagtgtatcccatctccacctcattcatgttcctagtgtgatgtggacactcctcccctgagatcttctagtcaatattccctccctttgtatacttgtggtctaggtactctatgtaactgccttgcttatatatgatgtactagcgatatcataatgggactttctgtaggctaaggtcatgatatagcactccacgtggggtctctctctctctctctcagcatgctcccttggtagttcttgaaccgggatggtaaaaagtcggcccacagagaggtagagaagcccaggggagtcccagctgtttgagtcttcccaccccaggcactcagacataataagtaacgtaaattcaaatgatttcatcccccagtttttaagctgtcccaggtgacaccaagtggtacagagacaagctgtccctgcaaagccctacagattcaataaatgtcatggtttaaaccaaaaaaaaaaaa

SEQ ID NO: 272 - DNA, 5943 bp, Homo sapiens
  misc_feature: Incyte ID No: 238660.5
agccattgtcctggatgacgtgcgctgctcaggaatgagtctacttgtggagctgccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgatcgagctgggacaccaatgatgccaatgtggtctgcaggcagctgggctgtggctgggccaggtctagaccccaggaaatgcccggtttggtcagggttcaggacccattgtcctggatgatgtgcgctgctcagggagatgagtcctacctgtggcagctgccccaacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcaggctatgagtcctacctgtggagctgcccccacaatggctggctctcccataactgtcagcacagtgaagacgctggtgtcatctgctcagctgcccactcccggtcgacgcccagtccagacacattggccgaccatcaccattgccatgcactcgacacgtaggatgctgaatcgcagatttgcaccctgaggctggtgaatgcgaggtgatcatggtgttcaggcctcgagtggaggttcctactaccagaggctgcctggggcaccgtgtgcgatgacagctgggacaccaatgatgccaatgtcgtctgcaggcaatctgggctgtggcatgggccatgtcagccccaggaaatgcccggtttggccagggttcaggacccattgtcctggatgacgtgcgctgctcaaggctatgagtcctacctgtggagctgcccccacaatggctggctctcccataactgtcagcacagtgaagacgctggtgtcatctgctcagctgcccactcgttggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagttgcccccacgatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggcccctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcgcatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaagtgcccggtttggccagggttcaggacccattgccctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactg

SEQ ID NO: 273 - DNA, 1759 bp, Homo sapiens
  misc_feature: Incyte ID No: 404601.11
  unsure 1731, 1736, 1739, 1742-1743, 1747, 1749, 1751-1752, 1754, 1756: a, t, c, g, or other
attttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaactcaggctcggtctttggcccaggcttcgagcatgggcctctgggggggagggagtggggaggataaagggtggagtcccacttccgctttccaactccctttttaggccaccgcattgtatatcccgacacacacacgctttgaatagagccctttggggtgggggagacttaaaggcagtttgtggtttggggaagtaagagttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaaagttcagtccctcctcctcttccttttctctttttctcccttccctgatagcgaaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatgaaaaaaaccnaaaancanatnntccnangnngnanaaa

SEQ ID NO: 274 - DNA, 1786 bp, Homo sapiens
  misc_feature: Incyte ID No: 1329936.3
tatgactgaggctgtttctcacatcctgcccctggttttgcctgtcccaaggatttcgtctgaagggcgggacattccccctgcctcttcgcaccacagccagagcctgccattaggaccaatgaaagcaaagtacctcatcccctcagtgactaagaattgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcgggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttattgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactaccaaaaaaaaaaaacaaagcggcctgctcgcgatctagaat

SEQ ID NO: 275 - DNA, 1011 bp, Homo sapiens
  misc_feature: Incyte ID No: 370489.47
acacagagagaaaggctaaagttctctggaggatgtgggctgcagagcctgctggctcttggggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagcggacgcgtgggtcgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcgagatcggctacgacttcggttctgagttcggtct

SEQ ID NO: 276 - DNA, 477 bp, Homo sapiens
  misc_feature: Incyte ID No: 197185.2
  unsure 363: a, t, c, g, or other
tgaagtcactgctgctctgggttcgggttggcgactgaaggcggtaccggcctcccggaacagcccgggggagggcttaggtggaaatttaaaattgtttacagtcaacactgtttccagccatgggtttgtctccatctgctcctgctgttgcagttcaggcctcaaatgcttcagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggantaccagttcaccatcctggacgtccgtccctgccttagattcactttcggcagtatgggacagaatgaaagtcgcttggtggcgttggacctcgtaaagcactgtttcagatgg

SEQ ID NO: 277 - DNA, 2464 bp, Homo sapiens
  misc_feature: Incyte ID No: 1822864CB1
ggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaagtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacatgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttaa

SEQ ID NO: 278 - protein, 486 aa, Homo sapiens
  misc_feature: Incyte ID No: 1822864CD1
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 279 - DNA, 3842 bp, Homo sapiens
  misc_feature: Incyte ID No: 2258794CB1
catggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagacctgacaaggaaggagttgagcctgggtaggctt

SEQ ID NO: 280 - protein, 1130 aa, Homo sapiens
  misc_feature: Incyte ID No: 2258794CD1
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKEVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 281 - DNA, 2731 bp, Homo sapiens
  misc_feature: Incyte ID No: 000506CB1
gggaaaccccgcgtgctgccgggatcgcgtctcagtccatcaggggggggagggggtggcgcgcgcgccatttctagtcgttttcaaagcgcctcgcgctgattctcacgggcccggctgccggcccccgctctgccctgcagcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaaaaaaaaaaaaa

SEQ ID NO: 282 - protein, 633 aa, Homo sapiens
  misc_feature: Incyte ID No: 000506CD1
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 283 - DNA, 3116 bp, Homo sapiens
  misc_feature: Incyte ID No: 407263.1
tcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttcc

SEQ ID NO: 284 - DNA, 1197 bp, Homo sapiens
  misc_feature: Incyte ID No: 1630551CB1
gccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaaaa

SEQ ID NO: 285 - protein, 325 aa, Homo sapiens
  misc_feature: Incyte ID No: 1630551CD1
MAAAAASLRGVVLGPRGAGLPGARARGLLCSARPGQLPLRTPQAVALSSKSGLSRGRKVMLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 286 - DNA, 2435 bp, Homo sapiens
  misc_feature: Incyte ID No: 2558815CB1
cggacgcgtgggcgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacatcgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattcgataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttaaaaaaaaaa

SEQ ID NO: 287 - protein, 518 aa, Homo sapiens
  misc_feature: Incyte ID No: 2558815CD1
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 288 - DNA, 624 bp, Homo sapiens
  misc_feature: Incyte ID No: 347411.1
  unsure 590, 620-621: a, t, c, g, or other
gcaaatttggggggagttagtataaaacacacggtggaaattcaggctgtgatgtcagcaagcttattgtgtataaacttcatttggccaaaatggttccaaatgatttcagctggtcttgttacaagcggagggagtttgagtatttcagtaagttttcttatgtgccatcctgcaagcttaagaatttctgctagtcaatggtttctttaattcttgggggcacagtttcaattacatgttactgtgtacagaaaagagtctttaggctcgttttacctattgtttctgaaatggaagtcttgagactcagagtgtctgtcatttaaaatcgtgatttagatcctgtcgtctgaataaatttggaaagccaaccttttatgcaatttttagagccagaaatagatcaaaaactaacttttttataggtcatttttttactaacatatttaggcccatttttttttcaaatatagttctgaagacatactgaaaaataaaaagtattagtagtataattaccaatacaaaactccagggagtattttctacttcaatttacagaggattttgagccccggattagattnttattgttatatttgtttcattccactgtnnact

SEQ ID NO: 289 - DNA, 861 bp, Homo sapiens
  misc_feature: Incyte ID No: 092230.2
  unsure 846: a, t, c, g, or other
acgagagctgccagacagtgtctgttcacgttctccagataccaggggcgccctgacaaagttaaggtcaagttagtgtcttatcttgggtggctcaaaatcaccgcatcgcgtcctggcgctgtgcggaaagctctttctcgcggagcggctggctgcgccccgaaggcctggtgcgctccctgcgtttcgggtggggccgcgcaggcaaggacaaggccacagagccggggtcttcacgttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggggcctggagatccacacgagggcgcgctcacgttccagaagccgcgtttgaccaagaggccgcggtaccttgtctgtccaacactggattctaataggcgacctcaaccccttagaaacaggcggcactaaggtgtttgctagtttatttgntctaagcagccatga

SEQ ID NO: 290 - DNA, 858 bp, Homo sapiens
  misc_feature: Incyte ID No: 333989.1
aaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaaatgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgt

SEQ ID NO: 291 - DNA, 3184 bp, Homo sapiens
  misc_feature: Incyte ID No: 333542.1
aaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgaagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagcagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaacaagggagagggagaattaccacctgtatctagaggtgctctttgcaatccctaagccctctggtcctgacctccgacctcctaacatgaccctttacctcccaccccagccccatatcctggtgtgggaaactgtcaccagtttccagcagtgtaagggcacttggagtcctatccagaagttgcatagcatcttctaggggttggggagagaagcatgtccactcgtctctgtggcctgaaaggctcagaagccatctgtccccacaaaagctgggctagaggaatctggagaggagtccgtcctctctgcagcactgtcgcccggcagtgtttcccttcaactctctccgcctatcttcccttcctttgggatcttccctttacctcaacctctttccctttccactccagactctttgctttcgctttcttttatggtggctgtccactcccaggctctgtcttgttccttgtctttgtctttcttcccttccccctgcccctgcccctaccggcccagctttggggacaccatcctttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaaggagatccttgtaaatagtggggtgggactgtttctgagtgatcacccgagcacttaaagctccagagtcccattcttcctggatggagcaggtggaggtgcagaggggatttcctcctctccttcctcctgtcgagaattaaacacctctccaaagccttcccctccagaaacaccagccagggagcgggtggggaaggaggtcacagccaagaaaactggcctggtacggacttccttcccttcccgcctatgtgagccatcctgagatgtctgtacaatagaaaccaaaccccaatgggcaccctcgcgttgccggggtggcaggtggggaggggggtgggaagaagggatgtcctgtctgtcgtccccctccccctctccactctttacccacagaaggcagaagactgttacactagggggctcagcaaattcaatccgcacccttaccaattgagccaagaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataaatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagattatatgtagggagagaagaagaaaaaaatacatttgtattcagagttaaatcttaaaaaaaaaagtgttttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctttcttccctctccccctccccctcaggggagccggcagagccaaacaaagaaagggattaacaagaaaggaagaagctgtaggactaaggactgaggatcctggggtgtcccccaaccactttccccctgccctgtcgcaggggcaagtgaggagggggaatccagaattaaggcctagcaggcctataggaaccctcagagatgtgtgagatttaagagatctaga

SEQ ID NO: 292 - DNA, 1004 bp, Homo sapiens
  misc_feature: Incyte ID No: 2426210CB1
gaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaatgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaaaaaaaaaaaaa

SEQ ID NO: 293 - protein, 277 aa, Homo sapiens
  misc_feature: Incyte ID No: 2426210CD1
MSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGRVVNISSLQCLRAFENCSEDLQERFHSETLTEGDLVDLMKKFVEDTKNEVHEREGWPNSPYGVSKLGVTVLSRILARRLDEKRKADRILVNACCPGPVKTDMDGKDSIRTVEEGAETPVYLALLPPDATEPQGQLVHDKVVQNW

SEQ ID NO: 294 - DNA, 765 bp, Homo sapiens
  misc_feature: Incyte ID No: 476760.12
aaacagaactaattttaagaagcctaacaaacccaactctgaggttctagtttgaatagaaccaataaagatgacttaggtcaacacaaaactttttattttttttttgaataacaaatataaattagaggtgggatactaatggtaaaataaggtgtctgctttaaaactctggagttcccgaatcagaacccaaactgtattcccttacattctgaaaagtctctaagttcagaggtgtgaatattattaattagatggcaccagtttagctctgtgtaaacttcaatctactcccaagtgcatgtaattcttccaaaaatatgggggaaaaataccttacctgaagcttctgtgggatttacccacttgcttcttgtcttgttcacctgacatttggtttctgcttgttacagaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttatt

SEQ ID NO: 295 - DNA, 4848 bp, Homo sapiens
  misc_feature: Incyte ID No: 064987CB1
gcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaaaaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagtgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttaaacacattaatcagggtatcattacttgcta

SEQ ID NO: 296 - protein, 1388 aa, Homo sapiens
  misc_feature: Incyte ID No: 064987CD1
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRENDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKKNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKCCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 297 - DNA, 291 bp, Homo sapiens
  misc_feature: Incyte ID No: 008450.1
gctcgagaagtaagtaagtacacagtgtcaactggaatgtgttcttgccaaaaatcctccacctgggtcttatcaaggctttaaatccaactgctggtttataggaagtttagggaatgaagacacaatcaggcaaatctaaaatgaaggatattctataagacaatgacctggtctcttcaatgctatggatttaaaaagggctggggaaggagggctggtgggaggactgttttagattgaaagaatgttgagacttgaataaccaaataaaataaacattgaaacagg

SEQ ID NO: 298 - DNA, 1560 bp, Homo sapiens
  misc_feature: Incyte ID No: 197652.3
agataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaatta

SEQ ID NO: 299 - DNA, 1345 bp, Homo sapiens
  misc_feature: Incyte ID No: 248203.2
gagtttgcgccactgcactctagcctgggggagaaagtgaaactccctctcaaaaaaaagaaggaccactctcagtatctgatttctgaagatgtacaaaaaaatatagcttcatatatctggaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaattatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctggacccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgtaaaatgcttatgtgagggttattgaaggtttccctgaagactgactggaaatggtggctgtttttttctatttctgactctgccatgaattt

SEQ ID NO: 300 - DNA, 3296 bp, Homo sapiens
  misc_feature: Incyte ID No: 2023351CB1
tctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgttgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaaaaaaaaaaa

SEQ ID NO: 301 - protein, 483 aa, Homo sapiens
  misc_feature: Incyte ID No: 2023351CD1
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 302 - DNA, 1181 bp, Homo sapiens
  misc_feature: Incyte ID No: 228610.1
cacagcctggtttcgctttgattgacacgcgtcaatctatagttgtggatgacagtgttcgggagagcccaggaactgtcaaaacttggttctctgcagtcctgaaggcactctgtctctttcggtcactccatctgacgattggtgcctgaaatacacctacggtttctggtcagcgtttatcagtggttggaagaacagaacccctaggaaccctgctgtcagcacgcagagtgtaaagtctcagatcaaggattcggagaaaggtctctacaggtccctcctcgttagtatagtggttggttgggatgagtcgggttggacccgtgcggatccaggaaaacagcgatcgaggtaaaagtaatggctgccgtcgtctgcccagcgcgcaattgtgagtgaccttcaccgctagcgcgcgccacccaccccacatgaacctgtagggttatgcccagtctacagacgaggaaaccaagatccagggaagctgagtcaccggcagagctgggattacgtctaagatttgtccagggggcgagaactgcagcgacaccatgatgatttatcatctccagaaaacaaaaaaaaaggcctagacacataaaaatggcttctctgtagagtgagctcaacgagctcaatgtgattccagttaaggaattgggccttaagccaaatgcgcctaaacgcaacttgcctctctattatttatccagaggatgaatttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaactgcgcatgtatccctaaggtctataaaagtaaaaataaatttaaaaataaaaaaattccctgttgta

SEQ ID NO: 303 - DNA, 3666 bp, Homo sapiens
  misc_feature: Incyte ID No: 092268.1
agtattcaactgccatccattggacgtgtttgggtcacactcagagcacccagcaggagaggctccctggtgtagtagtgcagcccagcactttcccggtgtgtgcctgcctaagtgatgtccactcgtgctgtaagcctttcatctgccgctgaaggcccctagtctggacgtctctgcccctctgggtccccgagctctgctagcgtagccctgggtacctactctatccctgccctagcctagcttctagtgtcccggggccgcttgttctctgcccggctctctgtgcccctaactgtgcttggtcctctggcttctctcctcctgctggagtgacctagtccctcgaggtctagtacccccgtccccggtagactgggccactaccacgtgccctcttggccctagccattcctcaccagagaggcggcactgacttacctggatggacttgggacaaaggttcctctaggtaccattggacaccaccacctgctgtagcttccactgtcaccaagagcagtgctagtggggcccactggggtgccctcggtctagtcttcggtccagcgtgcagctgcccctcggccttctcgacgtgggcggtgggccccagccccacagaccagcccagacatatcaggctggtaagagacagatcacccccaaagcaagaagtaccagatgaaatatgcataagacagcagacctcaaaactaacaaccaaagattacgccacacttcctcagttagaggaggagcagagatgaagaaaaaggagcagaaaagcgctggaaagagacagaaaaggaacctccattctgtgcagcaggctcctggcccagggagtgcggtgtgcggcagagtgcgtgcagggaagcagcctctgaaatcgtgcagggaagcaccctgtgaaatcgtgcagggaagcaccctgtgaaatcgtgcagggaagcaccctgtgaagtcgtgcagggaagcaccctctgaaatccgtgcaggtaagcaccctgtgaaatcgtgcagggaagcaccctgtgaatgtcgtgcagggaagcaccttctgaaatcgtgcagggaagcaccctctgaaattgtgcagggaagcaccctctgaaatgcctagaaatagctgccgggctttcacttggttcccaaatttcttcaaaggtcaaaaccatcacagtgggcaactttgcaccagtgaccagtcagtgctcactgtcctcaggccactgcagagccatcctagtggggcagtgggcgcggggcgggggctcctgactccggtgaggtcaccctggaggggagtcccaggaatcagcctgatgttcagaatgccttcctggcatctcagaagtgtactgggggagacgtgaggaccttttcagccaagtgtcagcgttcttattgcaggagaacattaaagccacaacccagaaacttctcaggagcatggcgcacccacaccagccccgggctccgcctggacagcacctcctgggcagcacctcctgagctgccctgaccagcagacaccatcctcccagcctctcttgtgccaccctgtgaccagctgggcaccaccctcccagcctcacgctggcaccctgaccatgcaggcaccatgccttgccatgccttgctcatgtcaccctgacccagatgggctgccctgaccatgctgggcaccatcctcccagccccactcatgctgccctgaccagctgggcaccatcctcccagcctcactcggccagccgagctctgtaggcctcagagtgcagagaacctcaaatgttgtgactttgctctgctgcagggacctgccatggagtgtcccttgtgcgagcattttgagagctatgccagcatccatccctgcaggtcccatccctgagccatttctcagtgagagcaggaagggagcagggagaggggtgctcccagccagccccgtgaaccagaggtctggggacgcagccgaccagccctccttgtctgggcctctgtttcctcttcgacacagggaagcagggaggggccgatcagcgacttaggcctgttggctgtggtggggtccacctgcgtttctggggagcccacggaccctggggtgtacctgggttacattcccagtgaactctcctattggtccccataaggggcgctgagatgtgatcgtttctttcctgagaatgagctgaggtaaaaacatgctggggaggaagatgggccctggggccagcgagctgcgcctctgcaccaggagaaagcccgtgtccccagagctgaggcggtggtgggcagggctcctgagaagccggggcagggcagggtgtctcctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctccagcagcccctggcccccacccgcacctctgcacctggccaacgcctgtctccggcagcccctgcccgcacaccgcacccctgtcacctgccaacgcccgtctccggcagcacctgcacacggcccgttccaggcagcacctgccacagcccgtctccggcagcacctgccacgcccgtctccggcagccccctgcccgcacccgcaccactgcacctgccacgcccgtctccgtgcagcacctgcctgcacccgcacccctcacggctgtctccgtgcagcccctgcccgacgcccgcacctctgcacctcccacagcccctcatcctggcagccccatgaccacaccctgcaccccttgcacgctctccactgtgactgtcttgccctgaggtgcccaaggtgcaggtctgtgaggagggcagccccgtgctcccgtggccaccgctcagccaagtggattcaagcgagggtttttagtgtttgtgcctgtgtccccgtgtgcctgtttcctggtgaggctggacgcctggcatgtttgaacaattcaaaattccccaggcatgcatgtgcagccgccgccgcgcaccatgtactgtggcgctgacccctcctgtaacagctgtgtgtcttggccctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgccaccttgcgtctgcgtgagtcctcggtccacgtgggccgttgcgctggttcccagcctgcccgacacactcactgcgacgcctcccttgcctaactgcttgctggcttctgtgttctctgcagtaaacaattgatttctgactcg

SEQ ID NO: 304 - DNA, 264 bp, Homo sapiens
  misc_feature: Incyte ID No: 016566.1
atctgactctcatttgagattaacatgagcttttgaatgcaggtctgcatttttacccagaagggactcggagagcccacataattaatttccatgggcaaaactgaaggcgttaccatgtaacttcataataaagccatgttattggctaatgcattcgtacaaaatctggaaggaagtgtcctagagtacatttccaattatttcaaaagctctcctctgaaggagtgagagggctctgcactctaagatggaataaagagt

SEQ ID NO: 305 - DNA, 452 bp, Homo sapiens
  misc_feature: Incyte ID No: 1329120.10
  unsure 299: a, t, c, g, or other
gccatggctgcgcccccggcccgcgcggacgctgatccttcgcccacgtcgccacctacggcccgagacacaccaggccggcaggctgagaaaagcgagaccgcgtgcgaggaccgcttgcttttctcccctgaccatgctctgaggatgccgttccctgtccgcacctgtgttctgtgtcgttttcgggcgtaactggcatctgtggagcgttccatttcctgtggaactccggagcgcggtggacagactgtgccgctgcaggaagctacaaagaggcggtcctgccgtttgcggantttccctcttgcccccgggggtctgcctgcacagacagtgactgtggttctgagttgtccccatcagcaatgcagagtccctggacagctcctgcacctgtgggcatgggcgcctccccggaagcggacacagcagtgaatcaagctcctgtg

SEQ ID NO: 306 - DNA, 9053 bp, Homo sapiens
  misc_feature: Incyte ID No: 898877.6
  unsure 2006, 2012: a, t, c, g, or other
ggcgatgaacggatcgctggaggcccgacgtctcgttcacggcccagccgtggggtcaggcggccccgcacttgtcgccggtgggccttggcctgcccgggtttggggggcatcgggctgggagcctggggggcctggcctggccctgcagggcctccagggccgggatgggagtcgtagtctcgcgggaaggtgaggccgccctctggggccgcccctctgcgggtgtcatcctggaggaaggatgggtctgatgttggctgtggtgtgcctcctggaagccggcagcacagcctgtgtgtgtggactctgctggcccgctggctggcactttttttctttttctttttttttcttgtgagagagttacttcaagttgtgtttggagctgacgtgagcgaggtgccagtgacggggtggcccgtgagctgatgacgaggactggcttttaatccttggtggtgattaagagaaagcttatgggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaaccggaagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcnacaacngcagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggcccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacggggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatcgtcaccaaagtccatgagcccccccgggaggacgcagctcccaccaagccagctcccccagaccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggcaagccgcggcagagccccctaacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtgggccaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcggggggggtgggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaatttagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactccaaaaaa

SEQ ID NO: 307 - DNA, 501 bp, Homo sapiens
  misc_feature: Incyte ID No: 029490.1
ccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctgcacttttttttcacttgataataaaaacatgattttatt

SEQ ID NO: 308 - DNA, 5252 bp, Homo sapiens
  misc_feature: Incyte ID No: 2619838CB1
ctccgagcagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagagtatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcgcaataga

SEQ ID NO: 309 - protein, 1564 aa, Homo sapiens [sequence omitted]

SEQ ID NO: 310 - DNA, 1332 bp, Homo sapiens
  misc_feature: Incyte ID No: 369213.42
gcctgctcactgactcttaactaacgccttgtaaatgctagttctgggctcagctgtgctcagctctttcctcatgtccgggcaccttgcctcactgtggcctctgtcctgggcttggttaactgcctgttctgtgaacttcttccctgcccctgctaggctattcatttgtgtcaccagatgcctgttcccagggagttgtccttcttccttgtcccaaaataccctttgattttcctggctggttggctgggactgttctcaccccgtcccctcgttgccttccagttcttcggcttcctcttggtgatattcgccattgaaatagctgcggccatctggggatattcccacaaggatgaggtaggtttttcccatgagatctcttgggtttgggagttgggggatgggggacagtgaagcagggggcaagtcctggctgggcactttgttcagctttcagctgttgaccaggcctcttatctcatcgcgtccctgtgtgccagcgaatgtgccctcctcggggcagggaatgtcagtgcgcttactgtcctgtccgagattgtgccagccatggtgttgactcatagtagatgttcagaaactacccattgggcctgtgcgtgtgtctttctgtccatctcacacctcagcagcccttccccacaacttttagaaagattactcaggaaatacaggctttctgtgggctggacacccttgcctcctcctctgatctataaataacatgttcaagtgctgcccccatgagccaagtgctgcccccaagcctgtgcagggtccacagatgtttgaactatgggccccacatccggagacttggccatctagtatggggaaaagacatgaaattgataagggtcatagaggtgatttatatccaaagtactatgggatttgaaaaggtggggctgggaagggaatctcttttggcttcatagagaagggagccgtgacctaaaccttgaatgagagatgcgttcaggaggaaagttagtggaggcaggggacttccagtcaaaggggctgagcatggctgagcttgggcttacgtggggagccctgcagagttttggaccaggatgggccatatcagagtagtgtttttggaagggctgccttgtcatgttcagcaggaagggggaaggaagagagatgctgagatgctggaggcaggaaccctattgttttgttttgttcttgagactagtcaagcgcggtagtgagaaacagggaagagtagaacaaggacttccatctgtaactgacgtgagcaatccattgagataactcactacttttagcccagcc

SEQ ID NO: 311 - DNA, 5415 bp, Homo sapiens
  misc_feature: Incyte ID No: 3557818CB1
ggggcggggaggctggcggagagtcggtggtgcgggatgccccgcctccgggccgcgtccgttctccacggctggtacctgtgtcgggtgggtggccaggcggggctcgcccccagccccctcgccagggctagccgactgcgcggcgcccggaggggacagatcaccggtaggggccgcggctagattccgcgctggagaacgccctctcgcggctccctggcccggccaccgcgctccctctccccgcccagagggccccggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattatttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaaaaaaaaaaaaa

SEQ ID NO: 312 - protein, 1333 aa, Homo sapiens
  misc_feature: Incyte ID No: 3557818CD1
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKIIYSRIPESETESTASAPNSPRTPLTPPPASGASSTTDVCSVFDSDHSSPFHSSNDTVFIQVTLPHGPRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 313 - DNA, 1788 bp, Homo sapiens
  misc_feature: Incyte ID No: 001622CB1
gtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaaaaaaaaaa

SEQ ID NO: 314 - protein, 490 aa, Homo sapiens
  misc_feature: Incyte ID No: 001622CD1
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 315 - DNA, 2169 bp, Homo sapiens
  misc_feature: Incyte ID No: 223407.4
  unsure 1034, 1043: a, t, c, g, or other
tctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgnggaggaagnagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaa

SEQ ID NO: 316 - DNA, 4051 bp, Homo sapiens
  misc_feature: Incyte ID No: 899334.1
gatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgaaaaaaaaaaaaagg

SEQ ID NO: 317 - DNA, 1064 bp, Homo sapiens
  misc_feature: Incyte ID No: 237299.13
gtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaaccgggcctggcacaagtgaccatgggaagcagaagcaggggatttctgcctggaatatgtcattattagtagcatcatcatacacaagccatcagctttccaatccactgcttccttatctagaaattaaggatacagcacacattttacaggactgttctgagaaataatatatgcaaatatatgcatagtgcacaataacacctgctttagaatgtttaatagctcttgcttcagaatgtttaatagctgaaatgatctatttcttggtttattcccctagaatataagcttcgtaagggcaggaccttgtctgtcttgttcagtgccgaaaaccatacagtgggcatatagtgggtattcagtatttgttacatgagttaaggaaacaagccagtgctgaaacccagatctgtctgcttctgaagctcatggtcataaacagctgttgagtgaagtgaatgaatggataccagagagggcctcactgctgcatcttgctttccctaccagcaacccccttgggcaacgtggaggagtgctaccgctacttcaccagtgtcctttttttgccatggagtcagggt

SEQ ID NO: 318 - DNA, 4297 bp, Homo sapiens
  misc_feature: Incyte ID No: 1149046.1
ggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttttcctgtcagtatatcatttttctgtcgcacctgttgcctgggagtttcaggcgatgaggcctcctcgcctacacacagccttccagtcatctggcttccccagcagtggagttcctaacagtgctcagggtgtgaacggtgttctgtggggacagtcaccgcagtgtgagcattcgtgagtgcctcgggactgtggcattcagagcatttgcctccaggtagtggcaggagggcgctcacgggaggagtgctcaggaagtacaggagagaagaagagtgtgccctgatggaaatgacagtgggacaccagtgaaagtggatccagaaggaactggaagttccacgtgcctggaaaacaggatggatacagaggaaactgaaaaatgtaggttagtactgaacctaattgaaatgtgtgtgccctcccaggggtcacacttcatcatatagttagctgggtttacttcttttaaaccaggaggtgatttaagatgtaaattttagacagtcaagccatctggtgagagagtaccagaggagatcaatcagttctctaggcgaggagctagggcctgtcctgggctgtcaccctgaggttggcagtggtgggccaggatacgtatgagaaacaaagcggaagtaaactggtcagaaagtgacttagagacgaaggcgtgtgtattcctttgtgtgtgtggcccgtaaaacatgggttgatcccattagttaaaggaggacaggagaagaaatggggtggtaggagcaaagagggaggatttcagttttgagtgcgttgaacatgaaatgtctgagggccttctgattggacacttactcc

SEQ ID NO: 319 - DNA, 500 bp, Homo sapiens
  misc_feature: Incyte ID No: 404011.3
  unsure 241, 256: a, t, c, g, or other
ccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttgggatgtgccagcgcctctggccgtggcccgctaaccagcctctcccgggcgggctcctggccgcgccccctctcgcttgcnccctcctccttcctncctcctgcttgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgc

SEQ ID NO: 320 - DNA, 3164 bp, Homo sapiens
  misc_feature: Incyte ID No: 3768043CB1
aggtttaatccatgaagaagacagcaattttaaaagtgtattcaccaaaaaataaagcttcaaaatatgtgatgtgaaaactgccagaactaaggcgggccgggctcagaccagcgctgcctcaggatgtaaagtgtaacaagagggccaggggaggtggtgggggacaacatgggcctgtgaggcctgtgggtgcccgcgttccccagctccccccgcagcccgctccacagtggtccgctccggttggttgtcacgtgcgcattcgggttccagacccaaggctgcgtgttctccaccgcttgttgtggccagtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaaatttagccttattcaaaaagagtatgaaggctatgaagtagagtcatctttagaggatgccagctttgagaaggaggcagcagaagaagcacgaagtttggaggcaacctgtgaaaagctgaacaggtccaattctgaacttgaggatgaaatcctctgtctagaaaaagacttaaaacaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaagggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaaaaaaaaaa

SEQ ID NO: 321 - protein, 806 aa, Homo sapiens
  misc_feature: Incyte ID No: 3768043CD1
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKEAAEEARSLEATCEKLNRSNSELEDEILCLEKDLKQEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSESENGAYLDNPPKGALKKLIHAAKLNASLKTLEGERNQIYIQLSEVDKTKEELTEHIKNLQTQQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPRDFPGPPPAPFAMRNVYPPRGFPPYLPPRPGFFPPPPHSEGRSEFPSGLIPPSNEPATEHPEPQQET

SEQ ID NO: 322 - DNA, 2770 bp, Homo sapiens
  misc_feature: Incyte ID No: 039946.19
ggtcccgacaggccggggttactgtggcgaccacgagagcagctttggcgctatggaggagcccggggctacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaagggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataaaa

SEQ ID NO: 323 - DNA, 3445 bp, Homo sapiens
  misc_feature: Incyte ID No: 1723834CB1
ggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccgaggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgtatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcgagctgagggcaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaaaaaag

SEQ ID NO: 324 - protein, 909 aa, Homo sapiens
  misc_feature: Incyte ID No: 1723834CD1
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRRAEGRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 325 - DNA, 1058 bp, Homo sapiens
  misc_feature: Incyte ID No: 2551987CB1
cagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttctgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtcaaaaaaaaaaaaaaa

SEQ ID NO: 326 - protein, 291 aa, Homo sapiens
  misc_feature: Incyte ID No: 2551987CD1
MASVTLSEAEKVYIVHGVQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 327 - DNA, 939 bp, Homo sapiens
  misc_feature: Incyte ID No: 232772.13
  unsure 151, 153, 159, 171: a, t, c, g, or other
tgaatatgtaacttttttctctttctgtatcctgttcaagaaatagttgtctactccaaggtcatgcagatgtttttttctaaatgctttattgtcttgtcttttattttttatatctatggtctatttggtatggcttcgtgtgtgtggngngaggtngggattgagatnctgtttgtttccattgggatatctgattgacccagcatcattttctaaaagatgcctttcctcattgcactgcggcgcctcctgtgtgcttttgacagggatgacagggatgaggatgataaagaataggcatagcgtgtctttctcttgtgagacacagggattccaactcctattctcaatcttaaaaagaagttatttttcctcctccaagtgggaattttactagtgcttctgcttccaggataccaagggttcgagtttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtcaaaaaaaa

SEQ ID NO: 328 - DNA, 2006 bp, Homo sapiens
  misc_feature: Incyte ID No: 407451.3
ctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcaggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcat

SEQ ID NO: 329 - DNA, 1931 bp, Homo sapiens
  misc_feature: Incyte ID No: 1382931.2
aatacgaccactatagggatttggccctcgaggcaagaattcggcacgagaactggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgatgctgctgcagccccagctaaggttgaagccaaggaagagtcggaggagtcggacgaggatatgggatttggtctctttgactaatcaccaaaaagcaaccaacttagcctttatttccttgtttgcaaataaaactggctaagttggttgctttttggtgattagtcaaagagaccaaatcccatatcctcgtccgactcctccgactcttccttggcttcaaccttagctggggctgcagcagagaggagcagctgtggtggcagcagccacaggggcagcagccacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctgggggagggaagatttcattttacgtgagattccctacaggaaaggaagtccaagtaagggtgaataaagagaacccttagcagacaataattgccaggttggcagctcagtctcaagagaggccatttcatctcataccaaatgctcctggcagagcaattcagccccatcaaataaattttgcccttattccaaatccaggtcttctgtatcccattgttgcatggcatttactata

SEQ ID NO: 330 - DNA, 984 bp, Homo sapiens
  misc_feature: Incyte ID No: 1382931.39
gggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgtgctgctgcagccccagctaaggttgaagccaaggaagagtcggaggagtcggacgaggatatgggatttggtctctttgactaatcaccaaaaagcaaccaacttagccagttttatttgcaaaacaaggaataaaggcttacttcttaaaaa

SEQ ID NO: 331 - DNA, 697 bp, Homo sapiens
  misc_feature: Incyte ID No: 411059.1
ctcaacattcctgaacataagttttttaaatgtaagatttgctatactttaaatatgatagtcaaaataaaaagacagttatcttgtacgtcattgtttatatgttaaaatattttttaaaacctaaaattttaaggatataaatattctacctaagaaaatccaatttggctgttaataaaagaaaaagcatttaatctataatgatggaaaatcaaattacacaggtgctattttctgccaacaattaggcacagattttttaaatgattacacaccccagtggtgaaaaaggacagggaatggatacattttatgcattaccaatggaaatataaatttatataagcttttcttaaaagcactttaacaatatctgtcaacaattttatgtaggttgaacatctcaaatccaaaactggaaatgctccagtgagcatttcctgtgagcattgcatcagcactcaaaaagtttatgattttagagcgttttagattacagatttttggatttggaatgctcaacctgtatgtgaaagaaaggaaaaggaaaactggacaacataagatgaactggaatctatacagtaggattaaatgaacattatagaactgcagaaatacagtatctgaaatcaaaaactcattggagaccagacacagaaaaagatgggattcatgaactcaagtacagtac

SEQ ID NO: 332 - DNA, 1395 bp, Homo sapiens
  misc_feature: Incyte ID No: 474862.8
atgaggaaagaggggggtctgaaagggagagagaagggtcatgttcctagaagagcccttctcaatggcttaacccatagagcccaggtcatagcctagagaagagaaaaacaagcccaaagcaaaaaggggatcccatcaaactgtatcatgagaccacatagcaggacatgtaatatggtatagacacagagcaaaatgtagcaaattagcttatcacattctcacatgagtctatttgtggcttctttggactggcctcaacctgctattctagagatacttagctaattccagatcttaagtctctggtcttaaggttcttgggaaatgtatataaattccatctcttcacctctttaaagtggtaatgtatccactgcactaggtgtgtggtttgccagactaggacaaatccctgaggaccctggagctaccatcttgggagcaagttaggaccatcttatggtttttgtgggaatttgcaggctgtagatgtagggatttcgaacccaaggttatgagggtaggtgaagtatggaaactctagaatcaggttgaaaagatttgtattttgcaggggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcagtgagatggggctgggcagaggagctgggggtgggggaagatgggcagccgagaaaagaagtgagaccaaggcagaaaatgtgtccagaagacagccacagcctcatttagcccattctggactggggaccaccatagagaaattcagactcctaaaactaatggataacttgcaggagattggggtgggagagggtacaaagtcaccaccgaggcttagcatctattttatactctttactcaagagggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctattgaccagaaatccatagtgttgagaatgctgatttgctcatgttttcaataataataaaataaaatacattcacacagacatacatttttgagagtattaatagtacctataaaatctggaacacagtgcctgcaataatgaacatgtaaaagcctgtagctgttattgctattataaaagatatatgaacagtcaaaaaaa

SEQ ID NO: 333 - DNA, 1412 bp, Homo sapiens
  misc_feature: Incyte ID No: 402366.1
  unsure 1173-1197: a, t, c, g, or other
ggaggatgtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtcgcccgggagggggctggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgccggggaggggcagggccccctgacactgcagcactgagacacgagccccctcccccagcccgtacacccggggccggggcgaggggcccatttcttgtatctggctggactagatcctattctgtcccgcggcggcctccaaagcctcgcagcccaccccgacgcacattcctgggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgaccnnnnnnnnnnnnnnnnnnnnnnnnntgggggagggtgacctagattgcagcataaggactctaagtgagactgaaggaagatgggaagatgactaactggggccggagagcactggcagacaggcttttatcctctgagagacttagaggtggggaataatcacaaaaataaaatgatcataatagctaacgcttagtgaatacttacttactatgtgccaagcacttaagtcatttaat

SEQ ID NO: 334 - DNA, 509 bp, Homo sapiens
  misc_feature: Incyte ID No: 401532.3
tccagtttaacaactaccaagtgcggtaccgacctgagctggatctggtcctcagagggatcacttgtgacatcggtagcatggagaaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgaccagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtctagacaacggggaagattatagagtgcggcagccctgaagaactgct

SEQ ID NO: 335 - DNA, 5696 bp, Homo sapiens
  misc_feature: Incyte ID No: 401532.2
cagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggagaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagctcgttctccttaaaacttt

SEQ ID NO: 336 - DNA, 1668 bp, Homo sapiens
  misc_feature: Incyte ID No: 407896.4
tggcacgaggctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtatccttattaaagaaatgagctgaaag

SEQ ID NO: 337 - DNA, 489 bp, Homo sapiens
  misc_feature: Incyte ID No: 982625.1
  unsure 84, 238: a, t, c, g, or other
ctaagatattagcatgtttttgaaatatttattttttaagatgtttaggagtaaggtcgtgttgtcttcctcaactaaaaagcngtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctagganatagtatgttgtatatgatgctgtgattgccctggagttcctgccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgtctagttcataaaaaaaaaaaaaaaaaaa

SEQ ID NO: 338 - DNA, 1447 bp, Homo sapiens
  misc_feature: Incyte ID No: 059947.1
  unsure 993: a, t, c, g, or other
ctagtattcatttcagtacatttatggagcctaatctcaatctctatgattgcttagttatattgacatttttacattcattgcttctattagaaactcagtcaataaattttgaatgaaaacctatgattttccaagcatcactctaggggctctggagaaaccaataaacaaaacaaaatgagaggctccaccttcatggagcctatgtcctattcaggggaagtcaataagaagctaacatcataaatatataaaaattcaaatgttatgtgtggtgtgagatgctgctttgaagaaacaaacaatagcatagagcgtggcatatctacgaactaaggaacatggagggttacagggtggagggggcttgggtccctattttcaaatagattggtcatggaaggcttcaatgaggaaagatcatttaacagacaggttttgaacgtcagctagaaagttaagtcttgtggctatctaggaaagagcattccaggcaagaaggaacatcgtaattgcaaagggccctgctggcagaagtgtgtcctggatattgaaggaacagcaataactgagggattgaaaagtgaatgagagacagagtgagtaaaaatagagtcacgagagtaggaagccaaattctgttagatcattgaagaattttaccttgcctgggtagaaggaaggaaatcactagagagttttgagaggaaatgtgaaaagatttgacctatatttaactgcatcattctggcttctgtgtggagttaggtgaccagttaagagactattgtaataatccaagtgagagaaaatggtgaattgggaaggggtagtagcattaagagtagtaagaagcactgagagtataaattatcttggaaggtacagccaaaataatcttttcacagtttggatgagagatgcgtcagaaaaaagcagaattaagatgactttaaggtgtttttctgttttgttttgttttaatttttnttctgttttgttttgttttgttttgttttgttttccagagcaaatggaaggattgggtttccattactgaaagataagagttattttatttgttctgttttcttctttcaatgcatttgtgtctaggtgagcatgtgggtacacaggatcaatcttaaatgagctatttggttatttttttcagttatttgtaatcagttgtcctgtttccactgtgatcaagttaaaaatggtactgtttcaaattgtcttgtgtcattgtggcaatagtttagttttcagttttttccttaagttgcttcataagaaataaattaatctataactcctctttcatatcgtgttatcactaagcttgagttatatagggaaatgttctgatatgattaattcaaggatgctgaagagcaatgagttgtgtgtaagcagaaaacaaaccagtacttaactagga

SEQ ID NO: 339 - DNA, 1538 bp, Homo sapiens
  misc_feature: Incyte ID No: 902471.11
tctgaacttgccgcttttgcattctttgagttcagtttaaagacggttactttaagagcattttaaaccctcgggctggaaatcggaccactgttaatcggccgcattgtttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtgatatatttaagaaaacgctaaaaagaatggaaattgtatgacaataacttaagtctttctccaaagtgcatgcagtcttttgcgatacctcattcagccgagtatttgtactcttcctcattcagtataaggaagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctaattttccagaaatgaaaaaaaaaaaatcagctctaaaaccaaagctgatttcagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttctaagtgttgtttttgccttaaaattttattttgcgtttcttcaaaactatagttttaaaggtattgatactgtgcaaatgctgggcatgcttggcacgagataatgtgtttcatttttacaaagttgtaatataactatgcaagtgtttcttaaaagaacacaagatttaataagttatgggattaaaaaaagttatggggtgaaaacgttatgggataaaaaatgtaaaaacgttgtggcaaaaaaacttctgggaaaaaagtagaaaacagtattatgaaaagttacaaaaaaagttatgaaaaagaagttacgggatttttttttaaaaagtcatggaataaaaataaaatgagaatcataagagaatcattgagaatcataaaaatgcagattctgattcagt

SEQ ID NO: 340 - DNA, 584 bp, Homo sapiens
  misc_feature: Incyte ID No: 442308.1
gtccggaggaagagaacgaggggcccgagccaaccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagcc

SEQ ID NO: 341 - DNA, 5056 bp, Homo sapiens
  misc_feature: Incyte ID No: 193755.1
  unsure 701, 4577: a, t, c, g, or other
ttcagctcggtcggctcctccaagctagaggaccgcccgagctgagcgcggaaggtgcgggcaagagccgcgggtctggagatgcaggactgggtcaacaggcccaagaccgtgcgcgacacgctgctggcgctgcaccagcacggccactcggggcccttcgagagcaagtttaagaaggagccggccttgactgcaggcaggttgttgggtttcgaggccaacggggccaacgggtctaaagcaggtaggggcggctgtgaagtgagggggtctaggggagaaaaggggacggagagcagaggaagggtggttctttggattcaccattttaccccagcccagaaacaacaaacaccccacttcctgatctgcctgaggcggaaccagtgcttggtggcaacgtgttcatgtgctgaagcagcataacagagatgagtcagactgggctgatacgctctgacacggggttttcctttcccagcacattgcttggatgggagcatgaggggcaccagtgcaccttttaacctattgggggacattagcagtcacatgttgagtgcaaacgagggtacttttgtgcatgtgtacaaacagggcagttacaagcgtgtgcattttcagtgggctccattttaaatcagtctggctggcctcagaatcccgtacgcctgaaggttttaagttgcatgtgcacnctgaaaactcgtatatgagtattttctgtctgtgcttttagagaggaggaattctgtaacgacttttgtttcgggttaggaagagaatgatctctttcagtgcaccgccacttatgttacctttttccttttatttctttgtgtttccagttgcaagaacagcaaggaaaaggaagccctctccagaaccacgaaggtgaagtcagggcccccctaagtatcaacggagaggcccagccgtgggctgtccacatccacagaaggggctccaagattccccatggactcctacatcctcttttgtgtctccgccaccacccactgcctcacctcattccaaccggaccacaccgcctgaagcggcccagaatggccagtcccccatgggcagccctgatcttagtaggcagacaatgcagggggcagtccatgccttcaaaagatgccaaccaggttcactccactaccaggaaggaatagcaacagtccgccctctccggtcctctatgaaccaaagaagggctggggccccagaaaaggtggggggcccagggagcaggcaacacaggaggactggaacccagggcaccctgccagacctcccggaactcctctctggcaaccagtgccccgctgtgctgcaccctactgccacgagcggctggcaggacacccatgtttgtgcagtgcccgtccgtccccttcgcccaagattctgcttcccttggctgccaagccaaagcatcaaacagcagggagtctagtgggagaggtctattgtcccagtggggaaaaatgccctctttgtggggctcccaatgtctccctggggcctttatgcaagggggaaatttgcaaccatcccttgctcggagaatgtgaaaagtgataaaagagagtagtactcgtgacttttcccggtttccaggaaaaaacccccaaatgattacccctttaatttaaaaactgccttggaattggtatatatatctccagatagtataaaatatcccaggacaaggggaaaatgtagaccttccataaaacatggctgtataaatatttgatatttttttgaaaacattgtggttcaataattatgtttttgaccgacaaaagggtatgtaacttataaagacatttttcttctatgtggtgaacgttaattagcactatctttgtgtcggttattatcctcggtgacacgttaccgctttctaatgtatggctgtgaacttgcgctgcttttttagagcactgtggcaaatacagaaatggcttttagctgtatttgtaagcacttattttaaaaagaaaaaaaaaagcccaaatacacttttctgacattgtaagattgccttactgtctgtcattccttattgctggcccctttctcaggccggaggcaaagtggtggagaaggaaaggaaatgatttcgaacgggcatgttgtcaagtgggcatgccacatgggaaataccaccagtttaccctgaaacattgtcctcagaggacgtaggaaagtggattttgaaatctctattttgcctcaaaagttcacgttcctgatgatactggatgactggagagtgctgctgggaacattttcacggatcgtgtggtcttttggggttttttgtttttttttttttaagacaaagtttgaccgctgtttcactgtccacgttgactcagttgtaagattacaatgctgcagtgctagtgggttacttaagatacaatctccagtgatggaaggcggttataatggatggtggtgttgtacaagatggcactgccattctttgagcagagcccagtctctgcaggcgccatcttcatctttttaaacaccctaagaaggttggttggtggtgctggtgtgccttatatttggaaagagtggcaagagaagttacagtccaggtgaacttggagatagtgggattggtttggttactgtttggtgttggtttatcatttaccctgtaggtgctattgctgttgatactattcaacctataaccctgttttctagtgagtgctgaatacagtatggtacaatgcacagtaaacagcccgcgtggtgcctgccccggacctgccctgtggggattatcagtgacagccccaaatgtggggtggaggaaacctgtaatttccctccttaacatgtgtttgaaatacccaagtgaataatactgttcctggaaaaaaaatgataaactagtggaaattaaagaaattaagggttttatataatagacaggccccacctactcaaaatatttttagaagtcctttttgtaaactaatttcttttgatcactattttgcatcagtaaaatgatttttttaaaaccaataaatcatccaattattagaaatagttgtctcacagtgatactggtttttcttttgtgctgttatggatttaacattggacagggaacactattttaaatccttacggttcaggtgtttgtaacttgggccttataattagggctgaattatgggcttcaaggtctacaatttatgtcgtatggttcacagcctaggcttctatgttacatttgtaaatactagattttttaccaactttgggattctttttttagttatatgtttgtctgttcctttgttaatattgttcttttactattttttaatggtctagttactaaacacttggataatatctagatgactggcaccaaatgacagtgttttttccgtagtggtgttgttaatggagtgcacctattgactactgtgccgagaatgtgcatgttttaccagtgcatgtgttatattacaactagactgtgctatggattaacctagttggttactacttactcttttccaagttgggagtatatatggactcagtgcaggactgggtctctccttaatgtgaatgcacacatgcaggaaatgcaggagtcaattttaacatgcccataaagacatttgtaaagaattcagctcttatggtctgttgtataaatgtgtatctaaggcactttattataactggaatttgacctcacagatgttacaacttgatcagtcgttgtgaccctaatttgtggtatgctatctagtatgttcttgcaagtcttaattacacgacactgcttatccaatagatagattaattacagaaaccatcctgccgtatgtaggataatgtctatccaagctgtggaaagggcaaccctgtggtttctctgtactggtgtttaatgggggaagaactagtgaacagctttaaagagctgtgtattgtggttactactattaaaaacatagactctgcacgacgtctgactggcctttggagtggcctttgtggacggctcgtagctggaacagtgttgatctgggttttctggcagttcttttaagttaaaaaagttaacatcgggacatgggtttgatcttttgttgtacctgtatgacagtgcctagattctccacagctgggataaaaatgtcacaaagctacttactgtacatgggccagtatcagatttccaaatccctaatatttcagctgtgcttttaatactccaaaatattaggggatggggtgttgttagctttccctttttttgcttttaacaatttatagaatttaacagatgtactgtctttcatgtggccatttacaataaatatttattaatcgtcattaaactgaacagaaacacgcaatgcacttcgggtgtccgacgggagtttcatcttcgctacaagaggaaggtaaaattgcgtgtgtgtgggtgagtgtgtgggtgtgtcgcctgtgggattgcatttttgcatcgtgtatttggatgccctgatcccctgcctccggtgggcaanaagggtctcccttttgccccttttttggggggaacctccagtaggagcccctcaaaaccttttccccgcccacccaccagctaaagccaagaggactccttggaccaaaaaatactctctccagacaccggaaatcgccaggtggcacaccaccgaggcacagtccgggcagggttggggctgcccccaggtctccatccccacccctcaccccaggaggggacagaatggccgcggggaggaggagccggcgagctcacctccttctgccccccggacgccggcgccgggcctgcttgtgcggcatgaggtgtggtgtgcgtgtgtctttcatgcaaaccctccctccccaaaccgaccccccaacagtttgccattccatacaaatttggaaacaggtttttaaaaaacagcatgacgcacaacggggacggggcgggggagggcagtggcactggggccccaaatctccgagtcac

SEQ ID NO: 342 - DNA, 597 bp, Homo sapiens
  misc_feature: Incyte ID No: 060957.1
  unsure 77, 97, 371: a, t, c, g, or other
ggcgggggtcgtcccggccgcccccaccgtcattaaaggcccctctcaaacactcgaggaggttttcggagcgcgancggcccgacagcatgaaaancacagggcgattgaaatgcgagcattgggacgcacggagccgccgcggcgcggaactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaanaaagtcgaattaattcattataataaagagagatgggcgagggagctcggccggcgcgcgcccctcctctgccctccccccgggccgaatagattacagctctgtattcagaaacaccgccgcgcgcattcctcctcgcgaacccaacagaagaccaggcgcttgtggctgctggcgaaatcgagtcggatggacggagtttacatttagtatttatagagacaag

SEQ ID NO: 343 - DNA, 721 bp, Homo sapiens
  misc_feature: Incyte ID No: 005124.23
  unsure 538: a, t, c, g, or other
cgcaggtgtcactggcctgactggtccctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagttccgtgatgatggtctaagcaaagacccttcgtcctgttaaagataaattaaaaaaaatcaaaaaaaaccaaagggaacaaaacttactctgcaaaagtaatatatgatttacctgctgttgtcataagaattccaaatagacaaactcggtatgcttgggatttgctttacattctaagtggatttggagaagagacaataaagaataagcagtcaattctataatatatttagaaggagaaaagtgccaaggaggaatgaaaaagtagancaaggcaaatgtggatatatgtttataactgcacaaatgaattctgaagggacgcataagacattggtattggttgcctatggggaatataattgatatgggggagacttggttttccttgtatgctcttctatatggtttaaaaaattatttatgaaaattaaatatatactaaaaaagagg

SEQ ID NO: 344 - DNA, 2193 bp, Homo sapiens
  misc_feature: Incyte ID No: 344166.2
cgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaa

SEQ ID NO: 345 - DNA, 3470 bp, Homo sapiens
  misc_feature: Incyte ID No: 1129157.1
gcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctatgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtatccctacgacctggtgcggtccccctggaagacgcaggaacacacccccacccccgatgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtggcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagaaaaaaaaaacaaagg

SEQ ID NO: 346 - DNA, 1312 bp, Homo sapiens
  misc_feature: Incyte ID No: 1804734CB1
gtccctaggagataagagtatcttgcacagcaggtgcaggtttcccagcagctcaggcaagagtccgatgtttgtgccatctgatcctgatgtctggagagcagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttcttgcttgattgctttgttgggggcctggccacttccttgcttctcaagctgacaattctcactttgcaataaatagtccagtgtttc

SEQ ID NO: 347 - protein, 262 aa, Homo sapiens
  misc_feature: Incyte ID No: 1804734CD1
MSGEQIAMCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 348 - DNA, 2137 bp, Homo sapiens
  misc_feature: Incyte ID No: 043646.7
gcgcagtgtgctgagcagctccattttgcggggagaccgggttggggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggattttttttttgttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtaaaa

SEQ ID NO: 349 - DNA, 1409 bp, Homo sapiens
  misc_feature: Incyte ID No: 043646.10
tgagagttaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggattttttttttttaatgaaaaaaaatttctattcatagcttatccttcagagcaatgacctgcatgcagcaatatcaaacatcagctaaccgaaagagctttcggtcaaggaccgtatcagggtaatgtgctgggttggcacatgtggttatggccttaattctaattttatttggtgtctctacatacaatcaaggtaaagccatatcacaaggatacagtaatatggccaggttggtaaaccttcattcttactagtttcattctaatcaagatgtcaaatggaataaaaatcacagcaatctcggattctgggtaataatatggaataattttttagaaggttacggaaagctcgtgcttcgggaatccctctaagtctgctggatagaggggatagtatgttaaaactgtgtactttaaaaaaaaattcaactctttacatctagaataatttgcatctcattttgcctaaattgggctctgtattcataaacactttccacatagaaaatagattagtattacctgtggcaccttttaagaaagggtcaaatgtttatatgcttaagatacatagcctactttttttttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaactctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatat

SEQ ID NO: 350 - DNA, 2445 bp, Homo sapiens
  misc_feature: Incyte ID No: 4674640CB1
ctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattg

SEQ ID NO: 351 - protein, 361 aa, Homo sapiens
  misc_feature: Incyte ID No: 4674640CD1
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 352 - DNA, 726 bp, Homo sapiens
  misc_feature: Incyte ID No: 025423.3
  unsure 437, 464: a, t, c, g, or other
aatgcttttgaagacaaagtaagaatttcagtattgacgttagacaaagaattgaagtcaggaaatagtgcatgacaaaagataattttgtggtaataaaagcatatgaacaaagcaaagataaaagtgtattgccttcttaattaaatgtagcttttgttgtggggaaaaaaaataagaaaagtatactgccttaaacactagataacactgtcaaaatatataaagcaaaagttgttagaaatacaagataaaattaaccagaaacagaatactgaatactagttggaaactttaagttttttcagcacatgcagtttcttattaagtagaaagtctcagttgtagacattgtatacgtaaccattagtacttacgtgacgagaccagagttgttctgtgttcagtaaaagttcatagttatcttcattaaactnggtaagaatgaaaataagtgaacttangaaatcaagaagagaaagtaaaagcagatccacagagaaaagcaagataataatgactggaaagcacgttttctaagtattatataaagaaacaaatgtcctaatatttctagacaatatagcagaatgaaaccaggagttgcttttctgacaagattaactagaacatctagcaaatctaattaaggaaaagtgagtggaaatccataaacatcactgatgagtaagaaaatggatagaaccacaaaagttataaaatttt

SEQ ID NO: 353 - DNA, 4866 bp, Homo sapiens
  misc_feature: Incyte ID No: 415378.3
cggcacaaagttgggggccgcgaagatgaggctgtccccggcgcccctgaagctgagccggactccggcactgctggccctgggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccagtggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggccctctgaccagcctggaccatcctcagagtcctttctatgacccagaggggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactg

SEQ ID NO: 354 - DNA, 643 bp, Homo sapiens
  misc_feature: Incyte ID No: 025685.3
gttttcctctccagagggatcagggtcctcttagggagtgacgggcttttcatatatttttgctgaagaatatatggaaagggtggcatttgcgtcacgtggaccaggacagtgctgaaatcagcagtgctcagaaacaatttaacatgttgaaacgacaatattctaaaatactgatgaatcttgcatcaatataattattgggtttttttctttttcctgctgtataactccttgccatgcaaactctcaagaggccaatatattcctggccatgtttgaatgagcctcttaaaataaacttagagccatgcaaatgccagcagcttaatggatttcatggaatgaaataccgtgattaactcatagctacatatcattgcataaatgggatttatcttttttctcacttattttttgctgtgaaagtcgagggcatgcaagagtttctcttccagaagccaggaggagaacgaaggtcctaatgctgtactattccaccctttggacgcctcatccaggacgcagaggactctaggtttaacattttgtacaaaacagaacctgttaatcacattaaagcacatatgtatatatcttttatttataaataaaattttaaaacaatagtttcagtatagcc

SEQ ID NO: 355 - DNA, 1926 bp, Homo sapiens
  misc_feature: Incyte ID No: 400427.1
  unsure 1922: a, t, c, g, or other
attttattttaaccagaggacaaaattaatctgcaaaagctgtcttggagaaatttcaggaaataaaagatcaaatgtatctgctgtcctcccttccctctccaggagaataaaaggcaaatgcaaactatcacagggagattttcacctttacctaaattatttattatatactttatatttctggttaatagattgggagagagcactccagataaagaacttcctttataaatgccacatttatttcagtactggaggtttggtcttgtgttgccacaaagatttggaatggcatctatgttataaatttagatgacaaaagagactaataaaagacttctagatgaaacacaagcttctaatattctggtccaggaaataagatagaaactaaaaaacaataaataacttttatgaattaactgaaggacttaaaatacttgttccattctaatcccaagtgtctgccaaggaactgaaatttaaaatgataaaagacatgatacagtcatgttacagggaattcaatgaagtaaaaatggcagacattgatgaatggtatggtttaaagatttgtgtagaggtagtgatgaggaggcctgctgggagctggaaaagttctataccttgacacagttatgcttacatggatatacacacacagtagtcactaagccatgatttgtacttatgatttgcacactttggtggttgtaaattgtacagcaatctaaaaacaaatgaggtcagtgtgcctcactacagagcttcaaaagtggtagatagcacatctcttttttcttttaagccatctaatacagagttgcttggaataaatcctaatagatacagtgtttctagaaacaagtaaatgaataaaccttagctgttaccccgtaggagccaacagaggtcaatctgttctcaagcttttacaaagttacaagaacaagtaatcagtgcatattttgttgaaactcctactgcaatactgaaaacttcaaatggagagcagctcctttttggtaattcacaacagacttagttttcaaattaccaagaatataaggaattagattagaagcctaattcaatttagaattatgagacattatttgtaacccacaagtattatttttcccatgatactgaacaattcacctggcatgaacttaaaagaagaaaatgcttattgcagccttcttgctttaagagcgaaaaaaacaattttgctagctgtggagggactagaatacaatgtcactttaagatttacactctcaaaagttttgacctatcagattgagagccagagagtagagacagacagaaggagaaggataaatcaaatgtggtataatgttaacctttgggggatcctgggtagtaggggatctgggaagttattgtgtagctattgcaacttttctgtaagtctgaaatgttgtgttgtcaaaagtcaaaagaaaaaatttataaatactttatcatccatttgctttataattaggtacagagtatgatgacagagagagcctactgtatgccagatacttaacagaaggaaagtagtttatatgtaaactctgggaaaagtggagccaaatgattacactgtgtgtaccctttagcactgtttggggtggggacatggggggtcagggtgcagagagggactgttctggtctccttggaaggtatgtgcctatagtaaaaagcatgagtaagatatcacatctcctaactccgtaacaaccaagcaaacttataatagcattttaacttatatcaccttttttataggagcggatatatattccagcagcatgagtattttagccctctttgcaattgcagtcttcattcattatcatcaataaactggcctctggttgattgatctagtctagttcttattntatc

SEQ ID NO: 356 - DNA, 5520 bp, Homo sapiens
  misc_feature: Incyte ID No: 198008.8
gggggaggccggcgggtcccgggcgccgaggctgcaggccgcagggaacgcgcactgggcggactccgcgccgccggccttgtagccattttaggaggaatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagttttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggctatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttagaccaagaagcaagagagtattcctagtattcccaaccatgaaaagtatcattctttgcaccaaatgttaacaaaatcatttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatccttgtatattgattagttaaagggataattaatttaatgctgaggagagtttgacagattttgaaaatgagtaaaggcaaaaaaaatttttttagcctttattttgcctttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtgcagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtttgtgtgtgtttgaaatacattgtgttctcagagatttctacattctcacgttctagtgatttggggcatgggcttaatagcagatgtacagtgtattcctggcattattgtgattcacccttaaagcccagttcttgctgtcttctaccaggggctgctgactccagttacccatggaatgcaggacctgggaggggtagccattagagtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatccctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaaaa

SEQ ID NO: 357 - DNA, 763 bp, Homo sapiens
  misc_feature: Incyte ID No: 1825508CB1
cggctcgaggccttctgctgctttgctctctgggagatccagctccttgctctgtgtcccagtagaacatgatgtggcccatgcacaccccactgctgctgctgactgccttgatggtggccgtggccgggagtgcctcggcccaatctaggaccttggcaggtggcatccatgccacagacctcaatgacaagagtgtgcagtgtgccctggactttgccatcagcgagtacaacaaggtcattaataaggatgagtactacagccgccctctgcaggtgatggctgcctaccagcagatcgtgggtggggtgaactactacttcaatgtgaagttcggtcgaaccacatgcaccaagtcccagcccaacttggacaactgtcccttcaatgaccagccaaaactgaaagaggaagagttctgctctttccagatcaatgaagttccctgggaggataaaatttccattctgaactacaagtgccggaaagtctaggggtctgtgcaaggcctgtcacactgaccacctcctactcccaccccctgtagtgctcccacccctggactggtggcccccaccctgggggaggtctcctcatgcgcctgcaccaggagacagacacagaaggtggcaggaggcctttgttgctcagcagggggctctgcccttgctccttccttcttgcttctcatagccccagtgtgcagtgcacactctcccacctcctgcaattaaacagtagcattgccaaaaaaaaaaaa

SEQ ID NO: 358 - protein, 142 aa, Homo sapiens
  misc_feature: Incyte ID No: 1825508CD1
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 359 - DNA, 694 bp, Homo sapiens
  misc_feature: Incyte ID No: 236957.9
cgacttcctcctggtcggcggctgcagcggggtgagcggtggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttga

SEQ ID NO: 360 - DNA, 331 bp, Homo sapiens
  misc_feature: Incyte ID No: 980807.1
ttttttttttactgaatcagtagtataggtgtctcttttcatgtttaataaaaatatatcaactcataatttttaatagttatacattatgatatgttccacagtccacatgaccaaatccctactggtagatattttacttatttctttttttaaaatactataataaaaaagtgctgtgctaaccttatctacttgtgtcatttttcttcttagctttaattcctagatgtgagtttgctagatcaagggcatgcttattctttgcttattcttctcccgtctcctcccgtttttctccttcctgcctgcctgcctgcctgcctttctt

SEQ ID NO: 361 - DNA, 2490 bp, Homo sapiens
  misc_feature: Incyte ID No: 1095192.1
aaaccgcaaaagcctatacctcgaccaggaaacaagtttcaaggaatggtctttgacctcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattgtttgtgggtaggccagtaaatcttagcaggtgcaaacttcattcaaatgtttggagtcataaatgttatgtttcttttagttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttg

SEQ ID NO: 362 - DNA, 1861 bp, Homo sapiens
  misc_feature: Incyte ID No: 167559.1
gctttgtggtctctctgaggactcaagcttctatctttttgctcctctatctttaacaggtgagttctagtctcgagggcaccctaagctccagggcccctggagctctggatgtcactggacttagaagcaaatgggagaaggcaaaagaactcttccccttcttcagtcatcttcttttaagaggcctatgtctgcttacatctcattatcctgtgtgtagtcacatggccacacctcactgcaaggcaggcaatgcagtgcaaccttaataacattggaagggaagaagggatattgactggcaaaaagtagtttgtgtcataaaaatctttgggcagtccttagtggtgagttgggttcattcaacacctgtggaaaaccagagtcatatggctctatgtcctattttactatattgggaacaaactcaggaatacagtctccagcctggaccataaagccccctgatcagaagtggggagctgtgtcttcccacacattgaaactagtctagtttccaacgggtgagagcatgtctgcaccatttctggtaggctctccctcatggatgcagttcctgagtggattctgtgcccgggtgctttctacattaagtagtctctttttaatttgggggatcctcagagtagtgatgggggtgttgggagggatgaaggtcttgtaatttctgactgtcagttgccctaaaatgaactaatgtagatgctctgagcctcccaatgttgttatactgtgcccttgtgggtagcctgttgcagtagttattctggtgtgaacctggaaattccctctgccactgtcctggatgcaaagttgtaaattctgtgggtgaaaccagttcatgaggagctcttccatatgctctttctaggccagagaggcagtctttagcagatggcagacctttacaaagacatcatatgtatccattccaattcatacaggctttcagctgaatggggactttgcagtgatatctcagcttcagtcagcaaatcttccaccaacgcagtgggcagggcctttgttctgaacccttaagggccttctcaggaccacccctcttagattcaccctcttctcccttcccctttcagaaggcccccacctgcagtgtattgtattctaggttcctctccctcaccccaggtccctcctcccctctgcccctgatgtaaactcagacatggcttggggtgagttctccttgagctgatactcttgatgcccttatcttttgggtgtccccaatacttgagaatcatctgtagtgttctccttaaccctattgagacactttttccatggacaaaagcatccattcctatgacattaagcctcacttccattaataaacccaactattacaccaccaggagcagctttggcttgggcagtaagtaccatggagagagcccaagtgaaccttgggtaccagacaccacagacagttccaaagactgtacctatttggcagtctgtgtaggcctatttttatgctgatatgaacaaagacagatttaggttttatgaagttggaaactcatataatttggggagtccctctttaatacaaactgaaaaagttttaattaaaattaggtataaaaataagggttgttttgaatgagaaaagttgacaactatgataaacacttaatgaaatcacagaaaaacaacatcatctttgtattaaatactctatgatgctttttgcctacttgttttggttgcttactctttgataatctctttattagctgataacatttatatcattttctgttcataaaatttgaatataatttagtcacatagttaatcaaaaaaaaaaaaa

SEQ ID NO: 363 - DNA, 3348 bp, Homo sapiens
  misc_feature: Incyte ID No: 1383286.12
  unsure 3339, 3341-3342, 3344-3345: a, t, c, g, or other
tgtcctgcagcactggatgctttgtgagttggggattgatgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggcatggtgttgctgctgtactccttctccgatgcctgtgaggagccaccaacatttgaagctatgggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagcaataaagaacctctcactgagacttctcattttatagaggttctttattgctcattttttaaaaaatggactcttgaaatctgttaaaataaaattgtacatttggagatgtttaaaaaaaaanannannggg

SEQ ID NO: 364 - DNA, 652 bp, Homo sapiens
  misc_feature: Incyte ID No: 040790.1
  unsure 244, 255: a, t, c, g, or other
agcttctgcagtatttatttctttaaatatttaacagtgttgagaggcaatgactcacaataatatgtagagtttctagcacattatgagtgcttaataaatgttagaacaataaaatcctgtatgatgaaaaacagtcagtaaaactatacagtctacgatattttaaagccatagcaataactagtttaaaaagaatagaaagcaaacagtgcattgattaaatcacggtcataaaggaacntttacgttcantaaaaagtccacccaggtaatttccccttgtatgtattaggggatggaaagaaggcacaggaaaagtggataaagtatggattaaaaaacaactcttcccccatccccccgccaccccccaaaagcccaggtggagctctattgaccacaagccggggtagctacatcccagtgcaacggtggggtgctcccaagcgccttcgaaacgtcctctacgccagcaccaactggcaaaaccttctaattttctagacgcctttctgcttggttttggaaggggaggcacccaagtgggtgtgtgcgacacctctagttgtaagccgggacacagtgacatcgagagagcgctattctactcggagaggaagttaatcccatcgaactccagccaggaaaa

SEQ ID NO: 365 - DNA, 2935 bp, Homo sapiens
  misc_feature: Incyte ID No: 053059.11
gccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttgaagggcaggcagctctgcaatagacctcaccttggactaacacctgagggctgcctcgccaggaaggattcaggggctcaaccccagcctgagtgcctgggctgggtggatccacagcggggcgaagggtcccacacacagcatcgatgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatttcacatcttctgacaggattccttgagggagggctggaccctggcacctggccagctccaggaagggtggccaggcccctcactgccccatcaagagtacttggtgttggagatcttcttccagagcagagtcttgaggtggctgagcaccagcgagtgatgggcctccacctggctggccagcccgctcagcgtggtacaggtgcgcagctgtgtgcccagctcctcgcggaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccagccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctttattccagccagcctcctggcacagggctgggcccacatcctggcctctgcatctggatcagggctggtgctggtcagcctggtcactctggccagtgctcacactggaagtccatcacaggcgaagtcacc

SEQ ID NO: 366 - DNA, 4181 bp, Homo sapiens
  misc_feature: Incyte ID No: 337156.2
cgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacacgactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcaaaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaaga

SEQ ID NO: 367 - DNA, 2820 bp, Homo sapiens
  misc_feature: Incyte ID No: 349630.7
gtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacggacaaaagcagtcaggatcagctgcggttctctctttccagatgttcagtacaacgagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggagcgcagcccgaagcccagtttcccttctatgcagtattgccacaatgcctctcccacgatgtcaaggactcctgtctgtcctggaggtgggagacaaggaacctccgaagaggaagcaaaaaagccgtactgtctatgttgtgatccttcatcgaacaaactgatgcggaaaacttgaatctgttactgaaatgaggagagaaggacatgtgctattgaactgagccaaacacactgtaaatatccacagactccctcccctgcccccatcccacatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcactaaaaaaaa

SEQ ID NO: 368 - DNA, 2913 bp, Homo sapiens
  misc_feature: Incyte ID No: 2125081CB1
gctccggcccgccccgctgcccggcccgcgcgccgggccatggagctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagagcgactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttaaaaaaaaaaaaaaa

SEQ ID NO: 369 - protein, 819 aa, Homo sapiens [sequence omitted]

SEQ ID NO: 370 - DNA, 1030 bp, Homo sapiens
  misc_feature: Incyte ID No: 1400574.1
tccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagctttattcgtagctcacaacttacccgacatcaaaaagttcatactggtgagaaaccttatgaatgtaaagaatgtgggaaggcttttagtcgtggctatcaccttactcaacatcagaaaattcataccggtgagaaacctttcaaatgtaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttactcatggctcaaaacttgttcatgaaagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatatcactaatatgaaaaaggcctttagacttctgtacagtcttattg

SEQ ID NO: 371 - DNA, 1448 bp, Homo sapiens
  misc_feature: Incyte ID No: 994430.15
cacctggcattcctctctgttcatggagcttctttgaggcttgaagtttgattttactatctagacctgctctgggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcagtgtattatcaggaaacatgtctatacgatcgcagagttgtatttcctcacaaacttctttacgaagagtgaaatacgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggacatacgtaggtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaaatgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgcgataaattattaaattgttgcaaagtgctgtttttgccttaaaattttattttgcgcatcttgaaaattatagtattaaaggtattgatactgtgcaaatactgggcatgcttggcatgagataatctgtttcattttcacaaaattgtagtataactatgcaagtgtttattaaaagaacacaaaataaaaaaggtatgggattaaaaaaaaaaaaaagg

SEQ ID NO: 372 - DNA, 2735 bp, Homo sapiens
  misc_feature: Incyte ID No: 2631218CB1
tggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgca

SEQ ID NO: 373 - protein, 414 aa, Homo sapiens
  misc_feature: Incyte ID No: 2631218CD1
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 374 - DNA, 2712 bp, Homo sapiens
  misc_feature: Incyte ID No: 3688791CB1
cgctgtctctccatgccaggactgagttgtgggggagggaggcggttagcgggctttagcgccttttctggcggcggtagatttgaagcgcttcaaaggaccggacccagagaagaggaaaactctaccggtgcagataagtggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagaagacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacgatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacaaaaaaaaaaaaaaa

SEQ ID NO: 375 - protein, 754 aa, Homo sapiens [sequence omitted]

SEQ ID NO: 376 - DNA, 2750 bp, Homo sapiens
  misc_feature: Incyte ID No: 3283554CB1
gagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcctctcgtcccggccaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcactttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagtgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccgtcctctggcttgggctaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttcaaaaaaaaaaaaaaa

SEQ ID NO: 377 - protein, 508 aa, Homo sapiens
  misc_feature: Incyte ID No: 3283554CD1
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGLSSRPGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPHFAQLLEMLRDQLAKWQWETHDPWVCAPDGVLEEKLSPQCQPLHNEL

SEQ ID NO: 378 - DNA, 1863 bp, Homo sapiens
  misc_feature: Incyte ID No: 4960375CB1
agtgcgcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaag

SEQ ID NO: 379 - protein, 449 aa, Homo sapiens
  misc_feature: Incyte ID No: 4960375CD1
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 380 - DNA, 1302 bp, Homo sapiens
  misc_feature: Incyte ID No: 222956.22
cgagccggacgggtttcgtaatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccggtgagtctccccaccccccatcctaacccaaagagcagtcagttactgtgtgctgtgaggtagccacaccatctaggatctgccatctaaaaaagcacacttcttgcctccctctgtgtcaggagcttctatggtcaggcagctgtatatgtggaacaaaggggactgggtgatggaagaagtgaatagtcctagctattacctcctgttcctgtccattctgagctgggtggggtttgtaggtggagctgcatacctgtcagttttccccattatttcatcatcagtcagaggtgactttgacatgtcctttctttgtccagtgttcactctgcaggccactgccctcactactctggttcatgtcttctgtgtgcttttgttgttccagctttgcctttcatgccctagtgatttccctgttaaaatgccacatcccctcttcccaccaggcccttagcttttcagtggttttgaagactcttttcccttcctccgtgctgactggaggaggggccttaagacatgactccttatcttctccaagcagaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaag

SEQ ID NO: 381 - DNA, 1575 bp, Homo sapiens
  misc_feature: Incyte ID No: 222956.24
gcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccaaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcacccctggcccactctagttatgacggt

SEQ ID NO: 382 - DNA, 2667 bp, Homo sapiens
  misc_feature: Incyte ID No: 973308.1
ctagttctagatcgcgagccgccgctcgggaggaaagttgagacggagagggttcatttgatcctgcgactacgctgcggcctcccgcccgctcccgctgcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaggccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgatctcgagccgcctttattgcttacgtcacatattccaatgaatacaataaactcctttttaaaaaagtaaggcacatgaaaagccttttgtgtaagttccatgttattttaaaattcctattggctaataaaagcatttgcactatagaaccagagacatctagaaaagcacatgatagatttttttgcaagcagaatgcctgaaacattacatttacctcatggcacaatgagacagtcaccaaatccaatgtctgcattagaacgatacagctactattacagttgcaaaaccattaatcagcttatccacatatgtacagctgggtccccacgtgacaaaatctaaaggaagaacagcatctaactgcacctgtgctccattccctcacagataggaactgtgacattttggctctttccatgttgtgctgctcttcacgagaggccagggtcatacgatactgaagaccatggacaggtactgttcgtacgacacctgaatccagccgtcctgatccgtgtcgtaacgtctgaatatatccgtcaacctctgcaggacgatgcagccctggatgaagtcgtcgaaggcaatctgcccccgtccctgcctgtcaaactttcgaatgaggatgtcgtggaactggtcagagagccggtagccgaaacctgagagggcctgcttcagctcgttcttatcgatcatcccggagttgtcccggtcgtacgtgcggaagacgttctgccagtccgtgatgtacttccacacacccgtgaactcgctgaagttcacgccggccttgttctcacggtcaaacatggatatgatcgacctgacagtcactggattaaagggagtccacgtgccgttggagagagcttgctgaagctcggtgtctgatatcactccactcctgtctttatcgaccctctggaaaacgttccacaggaagctctggtcccggcagcgccgcgccctgcagcaggcccagggccggggcggtaagagtaggcggccatgggccaaggcacgcggctgggctgaggcgcctgcagcgacgagagacctctcaggccgactccgcttccgcctctgccgggggc

SEQ ID NO: 383 - DNA, 2636 bp, Homo sapiens
  misc_feature: Incyte ID No: 238026.4
gtttgagaaaagcaggtatgaagtctccacgcgggaaaacaacttaccctctcttcacctgcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcaatggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggctttgagcatgtcgatgctgacggtgatctgcctggctgtactgctgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgccttgtgctcagggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaaggtgctgcaagacacggtcaaactccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaatttccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaaagtctgctggaccccagcacaggtctgggcctgggacgggctgagcgccctggacccggccgggatggcgagactctctttgcccctcaccaccaactaccgtgacaatgtgatctccccgtgatgctgcagccacggatggagccgaggaccttccagacgttcggcaaggcagaggcaccagagctgagcccaacaaggcacgaggctggccagcacctttgtactcggagatgagctcactgctggagatgctgctggaacagcgctccagacatgcccgtggaaggccgccctccgaggcgctgcggcggctctcggtctgcgggaggacccctcagttttagacttggccacctagtgcagcctcaggctatgtaaagtgtcaaggggacccaggttggaaagaccggggactgagggtcatagtagcatgaggctagcagctagctagcagcaggtgcctgtgaacatacctctagactgcctctggatccaagtgaccaggggcctgtaggatctgtggacaagagctggtttctaaaatcttgtaactcactagctagcggctggctctgagaactttagggtgactgatgctacccccacagaggacggcaagagcccccaggactaactagctgactggaccaaagcaagccccttgtaagcagctctgagtcttttggaggacagggacggtttgtggctgagataagtgtttcctgggcaaaacatatgtggagcacaaagggtcagtcctctggcagaacagatgccacggggtatcacaggcaggaaagggtggccttcttgggtagcaggagtcagggggctgtaccctgggggtgccaggaaatgctctctgacctatcaataaaggaaaagcagtgattca

SEQ ID NO: 384 - DNA, 1385 bp, Homo sapiens
  misc_feature: Incyte ID No: 1094829.52
ggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaagggtgagtgggccaccaccacatcgtcctggtgggatctagggttaggggcctcctacctttgtatctgactcacttggccccatcactcaaatgttttgcagaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaccttacgatcctcctggagagaagatggtagcagcaaaagtaaagggtgagaaactggataagaagctgaaaaaaatggagcaaacagacagcagccactaggtaccgccagaagaagagggcggagcagcaaagtaaagggtgagaaacctggataagaagctgaaaaaaatggagcaaacagacagcagc

SEQ ID NO: 385 - DNA, 2291 bp, Homo sapiens
  misc_feature: Incyte ID No: 1094829.54
ctccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaaagcgtagtcgggtgcccggactgcttccccaggagccctacagccctcggaccccgagccccgcaaggtcccaggggtcttggctgttgccccacgaaacgtgcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagt

SEQ ID NO: 386 - DNA, 2659 bp, Homo sapiens
  misc_feature: Incyte ID No: 899802.1
gaggcgggaggaggagttgccgagaggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcacacttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggggaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatg

SEQ ID NO: 387 - DNA, 3745 bp, Homo sapiens
  misc_feature: Incyte ID No: 107569.15
cggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcgacagctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgataaaaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatggcagatgggtcatattctttatttggaagaagttgtgacttctgacatgggtgtgattgtcttcctacactgttgcatttgattctttttatgtatttttaagaaagtaaccagttatactgcttttaatattgattggtctttttatttggcttggagttcttcaaagcattgaagtgtgttcatagtccaggttttttttttaataaacacaattttgctgccaaaaatatataaataaaacacgaaagaaaaattaaaaaatgttgaaaatattagaccatctccctttttaccaccttccctttttaccttttactgccatttacatccacacatccacacacacaatgctatgctatgtttaatagcatttccctgattactaatatgaagcattatatattgcctattcatgtttcatattttgtataatgtctatatcctttgttcattatttaattgtgttatttgtattctttatgtattattctttaacacattgctgtttatatgttggttatattttacattttcttctagtttatgggaagtctttttcttttcctaaggcaatctgttgataaatataacctgtgaatattaaagttattaaagttatc

SEQ ID NO: 388 - DNA, 1378 bp, Homo sapiens
  misc_feature: Incyte ID No: 236605.2
  unsure 675: a, t, c, g, or other
ggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgtggagggcggcgccgagggcccgcgggggtctagactgccccccatcacaggcggcgcctccgagctggccaaacggaaggtgaagacagaaaaacacaggaacgaagaagaccaaggggttctgccaagtgggggacgcagattaaacatcagagttcagagccgtgaagagccagccgctttcttcctcctttcatgacatcttaagtccttggcaaaggagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccaccccgaccccgaggccctcaagggcttccacccccganccccgaggccctcaagggcttccaccccgaccccgaggccctcaagggcttccacactgaccccaatggccggaaggaggcccctgagaacttaccctacctctcggacaaagatggcagctccagccacaggcagccccacgtcgaaagccgagtgccccaatctctgttttgaaggaaaccttaccccaaagcttctacactctgacttagctcctactctgctggagtgaaaatctacccacgacgctcacaaacttataattcctcctcaccacaagttttatgtgttaaaaaccatcatcataaaaggaaatgaggcccggtatctgaaggaaacagatgttcggtaacacggacgacgccgactctccccatcacccaagctgccctcggttgccccaggagagcccacagtgccttgaggaacataaggcaatttagtgaacagagttcttttcagaatttcctttttcttaagtaagcatctctgttacttaatttctcaccacagctagatgtctataatctggcccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaat

SEQ ID NO: 389 - DNA, 1608 bp, Homo sapiens
  misc_feature: Incyte ID No: 2705321CB1
cagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacataaaaaaaaaaaaaaa

SEQ ID NO: 390 - protein, 364 aa, Homo sapiens
  misc_feature: Incyte ID No: 2705321CD1
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 391 - DNA, 4715 bp, Homo sapiens
  misc_feature: Incyte ID No: 383863.2
  unsure 1748-2093, 4412: a, t, c, g, or other
cccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagagtattattaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgttcgtgttaaaactggagagtgtttaaaaatttcctttgggggggaagaaaagcacattgtaagattctcatgaaagaacatggaatttgcgctgttaacgtcattatcgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagtnttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaattttcatctaaggcatagagtggcgaaatttttgtaaatgctcgcagttagcatctaactaaaacaatacagtatgactttatttaggagaaggctttttatttagattttttt

SEQ ID NO: 392 - DNA, 2260 bp, Homo sapiens
  misc_feature: Incyte ID No: 903491.4
  unsure 1979: a, t, c, g, or other
ggatcccggataggaggaggaggggacccataggacgcgttaacatggacctggaaaacaaagtgaagaagatgggcttaggtcacgagcaaggatttggagccccttgtttaaaatgcaaactgagtatgaaagaaggtgacccagccatctatgccgaaagggctggctatgataaactgtgggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgcgtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaatttttttcggtctcaacttttaaacttggtttaagcatttgatttgtaaaacagtaaataattgtatctttccatagcttttcaaatgtgaaatcatttagttggaagcttggatctcattaaacttcatgtctctattccatttgtgccacacacttaaaagttagtgtactgaatgggaagatgagcatttctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttccatctgtggccttgaatattttattatcacatgtggcataacagtatccacacttttatagttctttattttttttttttattttggagcaattctcctgcctcagcctcccaaatagctgggattacaggtgcatgccaccacacccagctaattttggtattttaagtaaagacaggttttcaccatgttagccaggctgatctcaaactcctgacctcagatgatccgcctgccttggcctcccaaagtgctgggattacagctgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcacttaaaaaaaaancctctttttcaaagaggcttgacgtcaagctgaaactatcagtgagtggaagtaaaagcaaaaagtggggaatccttgaatttagcaaatacatctctgaagcttctcccccgaagttgggcccaagcaatgggaatgagaaaggtaactgtagccaggtgcgtatcttcaccccagtctttggcaggggatggggaggtggattcttaaggttaaggttggcaaagcaaaaggtcttaaagaaaagtgaggcactgtattgtgggggagttgttcaggct

SEQ ID NO: 393 - DNA, 2103 bp, Homo sapiens
  misc_feature: Incyte ID No: 332755.5
ctcactccaactctctaatttcagaatgcatggatagtgaagctgagaccgtcatgcagctccgaaatgagttaagagacaaggagatgaagctgacagatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggcgagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagacccctcgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaagga

SEQ ID NO: 394 - DNA, 690 bp, Homo sapiens
  misc_feature: Incyte ID No: 201694.5
tacccccgcggcccgccggaagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaacaatggaaagactgttatttgcaaacttgactcttcaattgaattacccattag

SEQ ID NO: 395 - DNA, 671 bp, Homo sapiens
  misc_feature: Incyte ID No: 065367.1
  unsure 43: a, t, c, g, or other
atagctcccttacacgtttgaagatctttgaatttgttggtcncacaagcatccctggggttcaaaaaatgtgggtattggaagaacacaaagtgagggaagctgtcctggtgatatctagatgtgagctgaatggagcttatggcaaagagacaaacctgagttaatctgcataatcaccgcaccacttaactctaatgggttagttatagggtggtatctctgcctcagtttctattgcaataaaatactggcatcatctcaagattctcagaaaatttaattaatattaatatttaatataagattaaaagcatactacaagtttcaattagcattaatcctttaaaatatggagttaaatgatctgtaactaattaaagactgcagttaacaggggacatgagttttttctgggttatatgaaacaaaatataaatcttttatataactcaatttcctacagaaaaaaaacttacttgtcagtgggattttaaagttttattttattttcttggatctcattacttttccataaatcctataagcagaattacaatgaggtgagtcatagacttaacacttttttggagtttcttctgccaaagcagcttgaaatatagaggattttcaaaaactgtgtttggggaacatgggaaggtatgggaaag

SEQ ID NO: 396 - DNA, 759 bp, Homo sapiens
  misc_feature: Incyte ID No: 199140.9
gctaggtctgttgagactcagctcaaacatcacattcttaattagccttctctgacattgaggcaaaactaaattggtttctccctttaaatagaactccttaagaagtaggactttgtcttgttccccttttattctagtgcctagtacaagatctgactagcaataatgtttgcaagaaaaaggagaaaagtaaaggttatcactgctccaaagtggctgtcaccctactaaccagggctgcccacccagactcccagagggcatacctggggctggaaactcactccctgcctttctgcagatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcagcatc

SEQ ID NO: 397 - DNA, 740 bp, Homo sapiens
  misc_feature: Incyte ID No: 1088542.9
caagatgggtgcatctgaggctctttagatgtgagcttgttggacatacacagtggctcctgaatgaccgtcacctagactggtagagagaggccgtgaaaatccccgcgcccaggcccagctctgattgggcaggtgttcctgccgctgatgtcccctccccggccccctgggcccctgtgagcatgagtgaggcagagccagggagagacgggcggacattggcatcaggctctgtgaggatactgcgcgtccagctctgtttctgttccttttcctgccaggatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatttccccccg

SEQ ID NO: 398 - DNA, 2994 bp, Homo sapiens
  misc_feature: Incyte ID No: 233513.2
agaaggaggtgggggaccatgggcaggcactgtggacgctaacctcggcccctccacccgttcctcagggcccacgtccagggggaccaagacctgcattcctagggccgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttaagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaaggcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtgtctgtgtgtgcacgtctgtgcgtctgtgcgtgcgcgtctgtgcatgtgtgtgtctgtgcgtgtgtgcgtctgtgtgtgcgtctgtgcgcgtgtgtgtgtgcgcgtctgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagcttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaaaa

SEQ ID NO: 399 - DNA, 683 bp, Homo sapiens
  misc_feature: Incyte ID No: 1330257.53
ggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcattatcccagaagtataaaagaataaaga

SEQ ID NO: 400 - DNA, 3172 bp, Homo sapiens
  misc_feature: Incyte ID No: 3676741CB1
ctgcgggggattgtgggagtctccgcgtcccgctcgctgggagagaggtacctctccttttccctctccctttccctaagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagac

SEQ ID NO: 401 - protein, 847 aa, Homo sapiens
  misc_feature: Incyte ID No: 3676741CD1
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 402 - DNA, 736 bp, Homo sapiens
  misc_feature: Incyte ID No: 346636.6
ggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacactgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcggg

SEQ ID NO: 403 - DNA, 1195 bp, Homo sapiens
  misc_feature: Incyte ID No: 1640555CB1
atggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatat

SEQ ID NO: 404 - protein, 338 aa, Homo sapiens
  misc_feature: Incyte ID No: 1640555CD1
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 405 - DNA, 449 bp, Homo sapiens
  misc_feature: Incyte ID No: 199286.3
  unsure 397: a, t, c, g, or other
gcagggtctagggtgttgttggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttnctgtaaaagacagaatggaaatgcccacgggaacccagaaaacagacacagg

SEQ ID NO: 406 - DNA, 888 bp, Homo sapiens
  misc_feature: Incyte ID No: 199286.2
ggaactgcagggtctagggtgttgttggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaaa

SEQ ID NO: 407 - DNA, 2007 bp, Homo sapiens
  misc_feature: Incyte ID No: 474200.1
gaaatatctcctaaaaatattttcgtggatgaatttagtgctcaggaaagagatttgtcagagctgagccgacacggaatgcagatggcggctgggctcgttcccacacgcgtgcatgcatgtgtgcaggagggcgcggctgtcagttcacttccagctggatctgccacccccggcttccccgagacagagcagaggctgtcattcaaaccagccccccaagatggtttggtcatgtgggcttagagtaaccctgaccggctccatctggctcacccaccactgctcggtttctgctgtctttcctagatcttaagacacgtgtttaggatcacgactacatcagaacctttcctcctcctatttccccagcatctgatgtggtctctcctccatcaagagacagagctttggaacagtaacagtaaaaacctcggggttaattatatcaacaactccccattgacttgcaaggttgagagagggccagagaacccttcctcccgttttttcaatcttcttcccttacattccaccagccctagttgtctactgtgcctctcagttgacaatgctgaggacactggcctgatgcgtgagagagggaagagaaaggagctctctgattcgccacccacctagaattgcacggtcctatccatctagtgatagaagcttgcacattttttcaacctaatacaaaaatattaacacttctggacattataggcataagttgttatatctctacaatataataattcatactgtacagctataacagataacaaaaggtgcaatccttttaaaaaaatcacacagttcacgtttttatcattttatttttaagtataaatttttaaacactttacataaattaactcctctgagactaagatttgatgtacagtaaattgtaattcatataaaaatccataaacaacttgtctcacataatttacaaaaaaatcaggatttcctttgcttatcagtgacaaggattctagttgccagttttttccccgaagggaaaccacgttagcattgtaaaatccattaataaatccccgccgcagaagtcactgtgccaatgtccttctacaaagctgcacagggaaagcagttgggttgtctagaaacagtaactttgccccacattgtaaaatgaacagagatagctatcacatcctatgcagacagactacttcttgtaagcaaaggtcgacaattcgggactatttggaaacactgtatacatttttttttcttttttaaagttagttaaatacagtgcctagaaggaacagacggcccagcgcaacaggtcgaggcctttgtccttgatgatttttttttcctctggctacgttcagtccgactgagtgcagcgctatgcatatgtaaacatattcgttaaagccgatcacctttaaggtcattcggaaaaaagcggtccttgttttcgcggtgtgggtgtgggtcgtaacagcagtctcattcccccgggaggaaggctcttgggcgttggagagtcccactcgggttgtgccacaggacaatgtgggcagggcgtgagcggctcggcgggcgcggcccgggcgttacctcctgccgatctcgctctgccgcaggaactggatgttgttggcgctgtcggccagctcggggtactgctccaccgagagtacgtagtacccgtcgtagccctgcaccttgccggcgctcagcagctgccgcttctcgccctccgtccagaggcgcgcgccctcctcgccgtcgcgcacgcgctgctgctcgcgcgcccaggcccgggcgagcgcgcgctgccgcgcctgctccaggatgcgcgccttctccttcgtccagggtcatgccgtagcgcacgtggcagcgccagcgcgccgaactgcatctccacgtccgcgaacctgcgcgtcctgccgatcaccaccgtggtggactgcgacaccgtcacgttgatgccgttctccagcgccttgcggccgc

SEQ ID NO: 408 - DNA, 237 bp, Homo sapiens
  misc_feature: Incyte ID No: 206397.1
ccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcgcccaatctcgtctaaaatagtccttcaaatatgtatctcttatagccttcagttatcccaacaaaattatctaaaga

SEQ ID NO: 409 - DNA, 3139 bp, Homo sapiens
  misc_feature: Incyte ID No: 199584.1
cggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaacttg

SEQ ID NO: 410 - DNA, 811 bp, Homo sapiens
  misc_feature: Incyte ID No: 401736.1
  unsure 287, 298, 310, 337: a, t, c, g, or other
gtattggattcacatattctaaaaatgctcgtcatttgtggctaattttatcaagtctagtttaatctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggccgagtgcagtggtggttacaactaattgntcacaaccagntacagactttgnttcttctcagcctgctgcttcacttgnctagccttttaaaaaaaagaaagaaaatagagaaaatcttaacttatatttacttactgtatgttgtgattagtttaatagaagggagtttaatccttaataattaagttagtcctcaacgtttattgacttagttctgatgtagtccttgtgtactattgtataatgtagactacttggccatacttgattttgtctaaaagttaatgcataaattaatattaaatatggccaaatataaaagtttaatgagtcatttgaggtcatttagccagaaaactgcatttatgttcctggtgaatttttttcaatgtccttttccaaaagtggcagtaagcagctgtcttaaaataaggagacagtgggaatgatgttgttaaagtcttttatacaatgtattgtctgtctgttccataaaaagtaaaactactctattcgtgaccagcttgggcaacatagtgagactgtctcttt

SEQ ID NO: 411 - DNA, 1123 bp, Homo sapiens
  misc_feature: Incyte ID No: 1100773.2
gcggccgcccgtagcctaattgcgcagagggctcgccttgcacctcctcttcccccgccgccctccctctcgcccagaaaggaggacggacccagctgcaggctccgagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcgcgcggcggcgccgcgcgagttccctgctcaccctccctctccgcggaagtccccacgaggtgggcttcagggtgtaacagagcgcgcggctccagtccgaaggcagcggccgggggagggaaggaggggaccgaacccccgaggagtctcgcagaatcaacttctggttagagttatgggaagcgcggttatggacaccaagaagaaaacaagatgtttccagccccggcgggagcggcggcaagaaaaatgccagccagaagaaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgttctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgacca

SEQ ID NO: 412 - DNA, 1114 bp, Homo sapiens
  misc_feature: Incyte ID No: 167854.1
  unsure 488, 505, 507-508, 510, 523, 529, 531, 543, 679, 809, 939, 1082: a, t, c, g, or other
ggaaaatcagtgcaggtttccagaagaggatgtgacaactcacattttgttcaattgagttaaataagcacttatagagtgtctaccacatgcagaacactcactgaatcgagtatggatgatacaaagaaaaatctatcccaagccctcctgcctacactgcctgagcctcatgggaccctaaataagtttggtaaggaatgagtggtgagaaagggtgaggagaaacaagagcacacatcgtcttgatacgggatctaaatgggtgcatggttctaggagaggcacaagggtttatggaggtagagattcccagtgtcccagatttgtttcttcactctcaggtcaaagcaggccttatttaggaggcccagtcattcctcatttcccttccttggtaatatcactacgattctctctcctcccactggccaaagtgtttgattaagcctgcagagaatgatggggttcagtaagaatggggggangagatgggataaaagcntnncngaatggagctganagcgtngntcttgagtagtnccccatggtctgtccagggggaggatgctaggctgagactctaggtgttctcgtagtttcgataaaaactataattgaccaccacaagtaccagtggatgtgtgagggtgaggggagagctgaagatgagtagttngttctgatttcagtttattttgggctcttctagcctcaagtctgtgttcagctaaagatatatggctgcataggcaaagggacctgttaggtgagcctgaaggtgattcttgcataattctcagaaactnaatcagggtcttcctgtatctcccgcttcctcccctttctcctgcctccaacctgcacatgtcagtgcatccacatgcacacacattcaagcaggacataaggcggccggccggtccacttcagatcatnaccaaaagtcttggcccttcaccactcacctgtcagcctcaggcagccagggacccagcatgggaggcacacctcatgagaactaccccaatgctcaagtgcccgcaaatgcccacaaacccttaaatgtgtctaggaacctntcaccaactgaagcctgactgcaagatgaagg

SEQ ID NO: 413 - DNA, 2056 bp, Homo sapiens
  misc_feature: Incyte ID No: 1693903CB1
gtttgcggggccaatgagcgactcgctttccgtgcggtgcggcgagtgaggctccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaaaaa

SEQ ID NO: 414 - protein, 426 aa, Homo sapiens
  misc_feature: Incyte ID No: 1693903CD1
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 415 - DNA, 1811 bp, Homo sapiens
  misc_feature: Incyte ID No: 351432.23
ccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggcctgctgtcgctggtgctcatggccggcaccttcttcatcgccttcttcctgcgcaaattcaagaacagccggttctttcctggccgggtgcgtgggcttaaaggccaagagggggttaggggcaggaaggggggtggcaggaagtcagcggctgtggtggcaggactctgagcgctgtgcctgcccactcagatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggtacgttgcctcttgcctttcccttcccagtggattccccagggctactggggccaggggaccccggggccaactctttctcctgcgcctcccgtaggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaaaaaaa

SEQ ID NO: 416 - DNA, 1225 bp, Homo sapiens
  misc_feature: Incyte ID No: 1252096CB1
tggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttaaaaaaaaaaaaaaa

SEQ ID NO: 417 - protein, 274 aa, Homo sapiens
  misc_feature: Incyte ID No: 1252096CD1
EPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGGYDGYNEGGNFGGGNYGGGGNYNDFGNYSGQQQSNYGPMKGGSFGGRSSGSPYGGGYGSGGGSGGYGSRRF

SEQ ID NO: 418 - DNA, 3248 bp, Homo sapiens
  misc_feature: Incyte ID No: 2545475CB1
gctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaacaaaaaaaaaaaaaa

SEQ ID NO: 419 - protein, 500 aa, Homo sapiens
  misc_feature: Incyte ID No: 2545475CD1
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANEQKKESKEEETSIDVAGKPNEVTKAAESPDQKDTEGGPKEEESPV

SEQ ID NO: 420 - DNA, 1822 bp, Homo sapiens
  misc_feature: Incyte ID No: 1756951CB1
ggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaagattgttgaacagaataatctttatcccagttaaatagttgtaccattggtagacttttttatggaggttcctagagggtggtgccctggggtgggcttggaagctctgcaccccttcccccatagctttccccgtgcatctctttgtctgtatgttttgtaatatcttttacagtaaactggtaaatgtgtttccttcaaaaaaaaaaaaaaa

SEQ ID NO: 421 - protein, 403 aa, Homo sapiens
  misc_feature: Incyte ID No: 1756951CD1
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 422 - DNA, 3012 bp, Homo sapiens
  misc_feature: Incyte ID No: 220134.6
atttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgtgcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtggcccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 423 - DNA, 1161 bp, Homo sapiens
  misc_feature: Incyte ID No: 220134.5
  unsure 347-349, 353, 357, 359, 361: a, t, c, g, or other
aacttttaataaatgagaagaaacacagtagtctgtctcatatagaacatttataataataacaatccataaagcctcatggtgaggtaggaacagctttggaaaataacacacagtcatgaaaacatacaaaaagttaggtaaaatgttgcagcactaaagatattttatctgcatctgtatttaatgagatgataactgcatttaactgggccacatctggcccaaaggacaggcaacagaagacacaaaacaacacaacatataagtttcataatcacagaatatactgatacacttcattgtgctgtttcaaggcagaaccataacatggcaatttgtgtctnnngtanatanananataaccacatattaattgtatgttacattccctctagcatctttttgccaaagacactggaccataaaatttttggtttaaaagtttaaattgaataacatacaaaaggctcttgtgccagtgaaaatgactgctaaatattccagagcttgttagtaaacaaaatagcattaccacatagtatcggtagagctacattataatagcactattttgatgtagctctaccgatactatgtggtaatgctattttgttttactaacaagctctggaatatttggcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaatttta

SEQ ID NO: 424 - DNA, 3187 bp, Homo sapiens
  misc_feature: Incyte ID No: 202164.1
  unsure 1255: a, t, c, g, or other
agacggagtctcgctctgtcgcccatcctaactaggactataaatcttttttttatttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatcgtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctggtgaccttagcagatctgtcacatttgaaagccatatgactcacttccaaccccttctaatgaaaaactgcatggtgttaaaagcactctcattagaaatataaggctgagaactgaagaaggctgtttaaagccaggaatttcactttattttactatgcctaaaaatacatctttgggaccccttgcaaagtgctttaaaagtactttcaatttatggcatgactccaaaaaagctaatctttttttcccaaaaaaacctctttatttaaataattggggatatttgctaaatacctatttttttttacagtggcctaaaacccctattaatgaaaagtgaaatttgatttaattaggactcttgcagtcatcttcacgactgaggagaagtttcaatagggctgtctagaccattatgatgttaataggagattaaaatacatttggcaattcattttcattcttaatttgagtgcatgaaccactgcagatgagctgataagcagagagaaattctccaagtgggtttcactaataaatgtttttttatatgatctgggaaggcaagtgaaatgggacggtgattatgtacgtgtataacaacattcagcacatttgaggaatcacacactataataaagcttaaacctgtcatagaaccttgatctatataactttgtcttcantaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattgggctttatactctaacatatagatactctctatagcaaaaaagggatgaatggccttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaaggggctaattatctactttgtgggtgtgttttgttttttcttttcagcgtgtagggcttgggctctgtttccttttattagcatgtcacctggagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaaatgttatattttgtttcaaaccctctggtctaagattattgagaaagatgttttttcctcctccctcaaatatgttatctcttcatatataaaaaaataagttattccatgctttacagttcctgaaaaggcatggaataacttatttcaaaaagatatttgaaaaagttttctctattctggacacccaaatgcgtctgccgcacatctgtgtatatgttccacaagagagaagaagaaaaatgggatcttaatttaaaaatatatatgtggtaatatctcgctatgagatattccgtctctataaaaaaaaaaaagggacacagctctctttataaaacccttgtttcagtcccatattcaacttcatgggaacttctggaaacatcattcaattttggaactttatttaagagcatttggtactggctggtctctgactggtcatgggaaaggttctggtaattctaagggggttactgggtttaattttaaatttcttcatctggtaccacagtcaaattagcaaccatctcccccaatccctggggctttctggtagatccagtggatgttaggtttaaacttctgttttctttgatgaagctttcaataaaaaatgaaaataaaatcaattg

SEQ ID NO: 425 - DNA, 1169 bp, Homo sapiens
  misc_feature: Incyte ID No: 406846.4
cgcgtccgcggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactacccaaaaccaaaaaaaacc

SEQ ID NO: 426 - DNA, 3093 bp, Homo sapiens
  misc_feature: Incyte ID No: 2716815CB1
gcagagtgctagcaggagcgcgagccagcaagaggcgcctgcgcgatgtccgggcccctgagccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataaaaaaaaaaaaaaa

SEQ ID NO: 427 - protein, 462 aa, Homo sapiens
  misc_feature: Incyte ID No: 2716815CD1
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 428 - DNA, 2320 bp, Homo sapiens
  misc_feature: Incyte ID No: 222278.1
  unsure 2290: a, t, c, g, or other
ggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggaattgaagacacttttaggacagctgccaccgaagtgagtctgcttgcgggaagcgaggagtttaatgccaccaaactgtttgaagttgacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgcgtgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccaggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaaganagtatataataaaatcataataaaaggtga

SEQ ID NO: 429 - DNA, 2440 bp, Homo sapiens
  misc_feature: Incyte ID No: 1273292CB1
cctgtccttgccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaa

SEQ ID NO: 430 - protein, 430 aa, Homo sapiens
  misc_feature: Incyte ID No: 1273292CD1
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 431 - DNA, 757 bp, Homo sapiens
  misc_feature: Incyte ID No: 067855.1
aacatttgtaaaactccacaaatgccttctgaaaaaatccatgtttaaccttaggaatttgttgtggtttctaatcatgcttttccgagtcccccagcccaccagcatccccacccctgagcttgtgtgagatgggcctgttctgggatccccaccctgtgctgacctcccagggctgaggtcacctgaatgtggggccagttggttcccctagcttgtacgttgctttgaacctcgtgtttcccacgagggagggggccccttctctggtcatcgcaaagacctgctccagaatgggcccttttccttcccattccctcctttggtgcctttctcagagtacatggacttccttctgccagactggggagagaagtctccatccccagctcctagggaccatgcagctgacctgctccaaggcacactggcagccccagcaaaatcctggagccggcaccagggcatgtcccacgagactgttaggagggctgtgcatctttgccccttggttgctcattgagaagcagtatagggcttccatgcctgtttggcctcccctggatccctgtagcagctgttaaaagagaacctttccaagctttgcacagtggcagtatcatagccaatgaggtttattactagttgaaaattttccccgaataccgccgcctgtgactgacgttgagtatatgaggcagcattggcaatttttgacagtttttagggatactgattattgagttgtgcaaaagtg

SEQ ID NO: 432 - DNA, 543 bp, Homo sapiens
  misc_feature: Incyte ID No: 027185.1
accacacagtaccagttttaaacctgttctattctaaccttggaatggagtcacatgtttcagcagcaatatgctgtttcccttcctcggtttctcacatcaccctctggagaatggtgtggaaactgccctgtttttacatcaagataaaagcttcaggaagttactggagagtggaatgcaggggtcattctggataacacaaaataactatttgattagaccaaccatttggtctctaaaattgggtgctaaagacaaagataggaaattcaaaaaatcaccacctgtagaagaaaaatcagttaataatttgacagatttaagggcctcacctttctctcacagaactttacctcataacaccctgtttgggaaaattggaaaatatcttctccttacctcctaggggataaacaagagtttaaatgttgccaccaactcaaacaaaacacacctcattctttatgttctggagggagagggagtccttattttgcttcaaagtttcctttctggagcttcttttttttaagtaaagaa

SEQ ID NO: 433 - DNA, 724 bp, Homo sapiens
  misc_feature: Incyte ID No: 240057.2
atggactcactaggctgctgaggaagatcaataatacctactggaatcagtcatgagaagtcaagcatggaaattgtgaattgtatgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaagcatctttcctagtgatcctgacatttagacggcacga

SEQ ID NO: 434 - DNA, 589 bp, Homo sapiens
  misc_feature: Incyte ID No: 017090.1
gcccgccaggtggaccggcccgcgctccgcccccagcgagccggggacccacccaccaccccccgcaccgccgacgccgcctcgttcgtccggcccagcctgaccaatgccgcggtggaaatgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaccaaaaaaa

SEQ ID NO: 435 - DNA, 416 bp, Homo sapiens
  misc_feature: Incyte ID No: 017021.2
taccaagaaagcccccacgatgccgaggacatcttactcctgctgctgggcctcatcgttcttgtcaacattggcatcaacgtggcaactatggtcagtgatgattgtggactacctctgggggtgaacagggccaagggtgggagccagctgcagcctacatctccacctgcagatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgcc

SEQ ID NO: 436 - DNA, 531 bp, Homo sapiens
  misc_feature: Incyte ID No: 235682.5
gaaatactcatctggaaaaaaggagctgtgcgccatctggtcatcggggatctcaccgctgaagcggtcacttagtgcctgccaaggagggaaggtgacatatgatggcactcagtagagagctccgcactttggccccccactgcaggcaccgtacaagcaacacaggcacagaagaaatccagtaacttctgctcattacccttgaccttcctgaccccactcacatcagtccttaccatgggaaaccttggaaagaaccagcccattccccaagaggtcaagataagcaaagttactgttctcccctaattgccttgcaggttataaacacctcacaccactcagtcttttattcaagaccaccacaaataatgatgaatgcccatttcatctatgtgaggctggaaccaagaaaccaagactcacgaggatggctcctctttaagccacaggcagagcccagatgtgatctgtgagtttcccgggcttctatcccagctataaccacaggcacttacttggagttta

SEQ ID NO: 437 - DNA, 825 bp, Homo sapiens
  misc_feature: Incyte ID No: 399329.3
  unsure 619, 631, 638, 643, 650, 702, 728, 731, 797: a, t, c, g, or other
actgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagttccacccatgtctcagaaatatcctaaggcataatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttatnaagttagcgtgnctataanatgantttggtntactgtgatgtctagtgtctctcaatctaatgatgaaagtttagaatgatgnaagtttcatttgtaaaactagctagntanaggcatttttctccagtaccttagcactttaccaggcaggaagcaggcttgctttcaagaatgaanatgaacggtcacaggtgaatttacaaaa

SEQ ID NO: 438 - DNA, 362 bp, Homo sapiens
  misc_feature: Incyte ID No: 068862.1
ctcgtgccgaattcggcacgagccaagagaaacaagcagccctgcaagtgcctagcaaggatgacaaatgagcttgacttccgcggcgacgtgactgtccacaaacatagcctggagcatgcacaatgcagcggcgtccacggcacagtgcaaatgccggaatgtgctgtggggttggacagagatcattgctgcagaaacaaaatgcagttttagattagcattctaggctatagatagctttgcttaattagaggaataagcaaataagtatcctgagtagcttctggattgtctcaacagaggaaaatgtataagtgaacaagttgcacgtaattaaataaaattcagtgtgatctggc

SEQ ID NO: 439 - DNA, 320 bp, Homo sapiens
  misc_feature: Incyte ID No: 008603.3
caggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctgggcccgctcctgagagcctgtggcatgcccttgaccctgcttggcctggctttctgcctccatccttgggcctgagagc

SEQ ID NO: 440 - DNA, 927 bp, Homo sapiens
  misc_feature: Incyte ID No: 337647.1
  unsure 558, 573, 579, 588, 594, 643, 655, 657, 661, 684, 696, 744, 757-758,796, 865: a, t, c, g, or other
gctttcttccagtgtgcacatgactaaagtgcttctgtccatcatctgggtcatatatagttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactgggtaagcactttcaaattttttttttttaactaaaagccattttaaaattgaatctgttgaggggcttgactaaaatcttttaagtaatttgtgtaatggaatactgtcagtggattttttcgtctcatttctgcacgtgctcctttgttctcagaacagaagctttttanacacatcccataacncagctngagagattnatgaantcagttattataaggaacacaaaggttgctttccattctttggcctttngataattaattntngtgntttcttaaaatggagtatttaangaaggaagaaantcacaagaaataaactgttggagaatttagaaaagtttgaagtttttnccaccttttctanntctagttttgtgtggccaaacacttgtgccgcctgggncggtgggggtagaggcaagcatagacagagaggaactaagccagacatggacaaaggcacgagccaaanccagacagtcctggccgttcgataggccagcagtgggtgagacaggtcagccagctgcaggg

SEQ ID NO: 441 - DNA, 2131 bp, Homo sapiens
  misc_feature: Incyte ID No: 200268.3
caggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagagtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaac

SEQ ID NO: 442 - DNA, 1056 bp, Homo sapiens
  misc_feature: Incyte ID No: 168861CB1
ggcacgagtggcagtgtctgccctgggatggccttccctgcacgcgcgcttttaacaccatgcaccccagctctaaagaaggaagactttcaagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaaaaaaaaaaaaaaa

SEQ ID NO: 443 - protein, 185 aa, Homo sapiens
  misc_feature: Incyte ID No: 168861CD1
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 444 - DNA, 638 bp, Homo sapiens
  misc_feature: Incyte ID No: 334738.1
gaaattttcagagcaggttcaaggcctagggctcagaatttgttccagaacttcatggtaatcttgcagccaagttcaagcttcatcctggtctggagggttctgattgctgatggcttgttactgtgggtgggaaggttgaaatctgggtattccctggggtggtgttactttttaatttaggaaatgacatttctttgtttgctgaagtcaggcattgagttaaaggcagctctctctccttcccatctagataagggctttcttttcagtgagtgttacccgtagaattctttttaaaagggcccctactgtttgtgtagatcctatgtgaatctttttatagcttccgtttgatttccattgcctccttacagttcaatctgaaagcaatctgtagctagcctggctttttaacagaaatctgtttccagttctggggttttcctaaagattgacaacttcgttttgagggtgtgggcagggttgttgagagctgccaagttactgtacaaaaaaggccagagttttaacttattttcaaatggaataaagcccattgtaaaggaaatacaatgggcaacagttgaaatcttcagagcaatggttagacttcacttattcattcagcaaatatt

SEQ ID NO: 445 - DNA, 2918 bp, Homo sapiens
  misc_feature: Incyte ID No: 410042.1
  unsure 23, 2864, 2867-2868, 2870: a, t, c, g, or other
gggaaggtagaaggtggggtctnccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcccttcgtgacttcaaaagtcctgggcactgttgctcatgagtgctgcacaactgtcgccctctaaagccacctccatccctcactgggctggcctcctgagccttcggtgaggaaacggggttccgagttgcccgcctgagagcttaacagtctgactagaaaagggctaattcgctttctgtgcaaatctcttgagctaattatttaatctgaaacatggacaggtaaaggaccattggcgggcgtggggagggaggtgtggaatctttcccacactttttgtcaccttaaaaaacacaaaaaataaaagacacccaaactcctctggtctgaatgggctgcctggaactgggcttcccggggccaggagtgggcccctagaagtttcccagtttggggtggggccggggttccgaagtctagagctgggagtcgggttcagcggcccgagacgctggctctcccagactcccttgcgccggggcagtgcgcgggggcggctcgggtccctcccgggccggcggggaccctcaggctcccggggcgccgcccaccagcccgacccggcggcctagaaatccccattctgctcccgcctcgccccggccggccagcgcagggcccctcaggcccgcaatctccaggctcaaacggcgaacaggtccccgcatccgcctgcctttgcacttgggggtgggagagccaccttgtgacgccccttctgcctctcaccagcttccccctttctccccgttctgtacggttccccctggagccagaaggaagcccggtgccagccagccttcctgaaagaccaagcccgcgccatccggcttcctccagtggacgcctgcaggacccaggtgagacacggaaccggttggggacgcgagccagggatcctgaccggttgggggcggcgagcaagggatcctgacttgggggcgttgcctcccggaatccaagcggccttttgcccgggtctcccgagatgcatcgaaattgagctcgtccacacagccccctgactgcgtgatgcccttttctgacttaaaacattccttgtacctttatttacacgatccaagttgcagtgtgcctagattttcctccaaggacaaaaatgtgaataaagcaatattttagccaaacatttctgtgtcaattaagaagattgcaattcgttccagactataaattctctttaacaactccctaaggtattcttttaaattgtttttcagcgttgctaaatgtgcatcataatgtgtgggagacttgtataaagtgaatcaatttatactcagctgattaattgacccgatgttaccacctccaaggaggcacctttccactattttctcattttttccccaacacatgttatttgttagtgaggaagctgcgtgcacgtggcattgtataaagtttattagacagacgtggcccttaaactaggaagagcttagtctaactctaaatctaaaattcgacatttcggtaagttgtgagacaagatacccaggttgtttgataaaccagaattgaacataattttttaaaaatttaaatcacaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagggggggtaatatatantcnntnactcagtgtaatattatacatcctttaaaaaatggttattgggaaatg

SEQ ID NO: 446 - DNA, 1550 bp, Homo sapiens
  misc_feature: Incyte ID No: 2026270CB1
cggctcgaggtgcatttacatgacagcaaggcctaagcaaacatttagcttctattggcacttgttctatttctaaaccttagaaaaaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcgggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 447 - protein, 177 aa, Homo sapiens
  misc_feature: Incyte ID No: 2026270CD1
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 448 - DNA, 1273 bp, Homo sapiens
  misc_feature: Incyte ID No: 522433CB1
gccgcaacctgcacagccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcacaccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaaaaaaaaaaaaaaaaaaaatggttgcggccgcaagcttattccctttagtgagggttaattttagcttgcactgacc

SEQ ID NO: 449 - protein, 308 aa, Homo sapiens [sequence omitted]

SEQ ID NO: 450 - DNA, 427 bp, Homo sapiens
  misc_feature: Incyte ID No: 234987.1
  unsure 415, 417, 419: a, t, c, g, or other
ggacaattgtgagaaacctccagttggtcaaatagccttcggaaacttactgctcattattctttctgatttttcttggaatattttgagagaaaagtcattattcccttgtatttcagaatcatgttaatgaggtagcttaactgctattcagctgcaggctcaactgagtgaaaaaggacaactagtaatggtaaactgaaggaaagactagtggaatcttgagaaagaataagagaaaaaagagaaatgttattgttttgatattacagattaagctaaccacagtacctgattcttagcaggtgcacaataattatttagtcaataattaatggagcaaatatttattaagtaacattgtatgtctgtgctgtctattgaagaatatacaaaagaaacctgaggctggggntngnttgggcgg

SEQ ID NO: 451 - DNA, 372 bp, Homo sapiens
  misc_feature: Incyte ID No: 1330257.32
  unsure 48: a, t, c, g, or other
gttataaaggtctcaaacacctttggaacaagacccattaaaacaaanttaccaccttaggcttattttcttgagaatctggcaaaagctatagactcagaaaagtgtacataacacaaacttgtacccaatttctgggattctggaaggcctcgagccgctcgagccgaattcggctcgagttctcacataacagtagaaaaccaaaatttgttgtcatctcttcaaagaatcgagaattgcgtacaaaaaaaaccttacataattaagaatgaatacatttacaggcgtaaatgcaaaccgattccaactcaaagcaagtaacagcccacggtgttctggccaaagtcatcagctaagaaaggaaactgg

SEQ ID NO: 452 - DNA, 700 bp, Homo sapiens
  misc_feature: Incyte ID No: 407023.1
gaggcttgacattgggtttttcaacagtctgatttaaattatcactcatttccttagtagaggttcttgagagatgcatctgcaaaggtggttgaagggacgcctttgggctaaacctgttgttggtggacatggtcacatgcctttgcactggaatgtctttgaatgcttcatttccaagagttgtgtgtagcatataaggagacatttcagcatcaggcttaactccaacagagtttcctttgtctcttaacggtgctggattaggttttttgccaacagaaaaatttgaagcaaatcctggttgtctgagggttgcttttggttttccttctagaaaaaatggcatggttttcttcactctcatctgacaattaacttgacgcccggttttccttttagaactcctttgacgagccacaagctgagcaattcttgcagtttctgtgcaggccatggcatagcaggtaatctctccagatctactagtctctatcctgaccactgctggcacacttctcagataggcttctagtgtagggaaacctagctgtttgaaggggatccagtctccagtcaaggatctgtactctccttggagccggggtaatgctactccattcttatgagactgcagaacagctcgcagcatctttgaaaccagatctccttccagcatctttgcctcgttccgggggcc

SEQ ID NO: 453 - DNA, 942 bp, Homo sapiens
  misc_feature: Incyte ID No: 3117184CB1
cctccatcagctcgccgcgcagcggctgtatttgcggcctgtgcgagtaggcgcttgggcactcagtctccctggcgggcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggaccccacccccgcagtttccaggatttcctccacctgtacctccagggaccccaatgattcctgtaccaatgagcattatggctcctgctccgactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttcggcagatttcagtgggcccactgat

SEQ ID NO: 454 - protein, 252 aa, Homo sapiens
  misc_feature: Incyte ID No: 3117184CD1
MSFPPHLNRPPMGIPALPPGTPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFGRFQWAH

SEQ ID NO: 455 - DNA, 2350 bp, Homo sapiens
  misc_feature: Incyte ID No: 3105671CB1
ccactgcagataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttgtgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggtaacaaaacattcagacaagcctgaatacaatgttgtttctccagaaatatcaatccataatgagatagatcatgaggagtgccattaattctcttaaaaatacatggaattcaaaaaaaagtttattttaaaaacacttgaacaaaattacgcacacaatgttaaattagtggctcaactatgcaaaatcctttttggttatttaaaagacttcaacaaatgctatcagaagactttcctacgtatccaatatttctctgatataaaataatagaaccagttacttactgcacctattagtttaattagtatttaatatatttttgctcatattgcaggggaagagaagacaaaacgagtctttcattcggtgtgaacttttctctttaattttaactgatttaacactttttgtgaattaatgaaatgataaagacttttatgtgagatttccttatcacagaaataaaatatctct

SEQ ID NO: 456 - protein, 609 aa, Homo sapiens
  misc_feature: Incyte ID No: 3105671CD1
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 457 - DNA, 1205 bp, Homo sapiens
  misc_feature: Incyte ID No: 2051966CB1
tgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaaaaaaaa

SEQ ID NO: 458 - protein, 345 aa, Homo sapiens
  misc_feature: Incyte ID No: 2051966CD1
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 459 - DNA, 3033 bp, Homo sapiens
  misc_feature: Incyte ID No: 1969731CB1
ctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcaacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaacaaaaaaaaaaaa

SEQ ID NO: 460 - protein, 394 aa, Homo sapiens
  misc_feature: Incyte ID No: 1969731CD1
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 461 - DNA, 1792 bp, Homo sapiens
  misc_feature: Incyte ID No: 2171401CB1
cgccgctggggccggcccgcacggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcaaaaaaaaaaaa

SEQ ID NO: 462 - protein, 468 aa, Homo sapiens
  misc_feature: Incyte ID No: 2171401CD1
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 463 - DNA, 4855 bp, Homo sapiens
  misc_feature: Incyte ID No: 1326983.14
  unsure 4800, 4805, 4813, 4816-4817, 4822-4823, 4831-4832, 4835, 4837,4839-4840, 4849-4850: a, t, c, g, or other
cgacgccgccgccttagaacgcctttccagtactgctagcagcagcccgaccacgcgttaccgcacgctcgcgcctttcccttgacacggcggacgccgggaggattggggcggcaatttgtcttttccttttttattaaaattatttttcctgcctgttgttggatttggggaaattttttgtttgttttttatgatttgtattgactgagagaaacccactgaagacgtctgcgtgagaatagagaccaccgagtttcgcaggccgactcgcggggccgctgcacccaccgccaaggacaaaaggagcccagcgctactagctgcacccgattcctcccagtgcttagcatgaagaaggcccgaaatgggacgattcagtatttccccgggatgaagacagcagcaagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaatgctcttttataattctctgacatttgtgtcaatatttccctgtattctgttcatctcctttgaagactgccaatgaaggagggtctttattatatgaccaattgggatatacaggcatttggacttagttggaaagcttgcagccatcctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttccttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaanaaaanaaaaaaanaannaaaannaaaaaaannaangngnnaaaaaaaannggggg

SEQ ID NO: 464 - DNA, 393 bp, Homo sapiens
  misc_feature: Incyte ID No: 339106.1
  unsure 372, 374: a, t, c, g, or other
cccatcctcccgagttggtattttaataatccaagagattctaacatgctttagctaatccgggatttagaaggggcaacacccaaatcaaacctagaaggttgcaaccaacctgggcagtattgaccagggagcatttagtctttttaaagatcctcctctctctcttctgcctattaattcattccgattaatctgtcatactgggtggtatttaaaaggtgacacacattcgtattagtgagctgaggagaggaatgttgctccttttctttcgccctttgttctttctcatttcaaattagatgaccaataacctcccagggaggcatataccaaatggatgttacatgtgaagcaaattgtaagagncnataaaaaataaattctaat

SEQ ID NO: 465 - DNA, 1038 bp, Homo sapiens
  misc_feature: Incyte ID No: 331666.1
ataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaaatttttgtatgttgc

SEQ ID NO: 466 - DNA, 860 bp, Homo sapiens
  misc_feature: Incyte ID No: 1422432CB1
  unsure 205: a, t, c, g, or other
agagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccangtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctcaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaa

SEQ ID NO: 467 - protein, 95 aa, Homo sapiens
  misc_feature: Incyte ID No: 1422432CD1
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 468 - DNA, 1498 bp, Homo sapiens
  misc_feature: Incyte ID No: 409895.2
agctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggtattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctgggacacacagctctctgggccccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatg

SEQ ID NO: 469 - DNA, 1503 bp, Homo sapiens
  misc_feature: Incyte ID No: 245136.9
aaggttcttccacatgtgggacatttgtgtggagattcctgttcagatttgaagcaagcaaaggattaatccttcacaccaccactgcacccttttcaatagtttctgtcttatcgttatcacagcgttaacataacactctcatgacaacaaaagaggagacttgcaggaacaaatccgtgctcctaatcttccaatcatgaaaatacacgtgcaggcatacacagaggcccgattacactgataacttcggaggcagacccgcagccacctcggtgggctttgtgatttccagctcttcacatttcatcaccatgtcataggcaggaaaagggggaaggaaaaactctaatcctctcttaaggaacaacattctcctgggtaataaggctcctctttgctggaaaactaaactattcctcaatgtcctgaaagctacaaattatgaggcccttgggaaagagaacgtatgggatttcaggacattgaggaatagtttagttttccagcaaagaggagccttattacccaggagaatgttgttccttaagagaggattagagtttttccttcccccttttcctgcccatgtcataggcaggaaaagggggaaggaaaaactctaatcctgcctatgacatggtgatgaaatgtgaagagctggaaatcacaaagcccaccgaggtggctgcgggtctgcctccgaagttatcagtgtaatcgggcctctgtgtatgcctgcacgtgtattttcatgattggaagattaggagcacggatttgttcctgcaagtctcctcttttgttgtcatgagagtgttatgttaacgcttgtgataacgataagacagaaactattgaaaagggtgcagtggtggtgtgaaggattaatcctttgcttgcttcacatctgaacaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttttttgaaacaaacaag

SEQ ID NO: 470 - DNA, 3495 bp, Homo sapiens
  misc_feature: Incyte ID No: 2600262CB1
  unsure 2831-2993: a, t, c, g, or other
cgcgcccgcccgcctgctacgagtagaacgctgtccgcagcttggcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacggaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttgggcagccttgtgatgtcatacagagaagtcacaggggcagtacctgagggtctgtagggttgcacactttggtaccagataactttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctatcatatgaataaactgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagcttagttttaagggttgtatgatgttttcatctgagaagttctgaaacgtgatttctagtcaatatcttgcagagataaataatgcaaattagctgaaaatgctataaatttccaaaggcttaaatttcgtttatggcaggttgtgtagaaaa

SEQ ID NO: 471 - protein, 395 aa, Homo sapiens
  misc_feature: Incyte ID No: 2600262CD1
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 472 - DNA, 98 bp, Homo sapiens
  misc_feature: Incyte ID No: 070246.1
gactgacctgctctgagcaaggaggaattctgctggccaactgcttgtgaactccaacttgtaatatcagtctccacctaccggcttactctgcagat

SEQ ID NO: 473 - DNA, 1319 bp, Homo sapiens
  misc_feature: Incyte ID No: 1086183.1
gtcacaaaaagaaaggacgggacttttgggggggcctcttcgtggcggccattttagcttctctgaggtgtgttcaccggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacgttggggccatcagtcacagaggaaaaactcattgcaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggattacaggcatgagccactgcgcccagcacaatgtgggaagctaatggacaagcagtttagcaatgttacataaatattaaagaagtaagcagtacgtataggttaataaactcaaagacacacctactaaacatcaaatatattttgtatgctgatagcaatctgtcttaaataagcagcagttgatacaattcagtactgtatataaaacatttataattttgtacacatacaatttttattttgtatgttaatcttatagttacgaaaacggtctttgggttttggaaa

SEQ ID NO: 474 - DNA, 2618 bp, Homo sapiens
  misc_feature: Incyte ID No: 900070.12
gccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgc

SEQ ID NO: 475 - DNA, 1167 bp, Homo sapiens
  misc_feature: Incyte ID No: 231182.1
  unsure 101: a, t, c, g, or other
cggccgcccccgcccgcccggggaccccgcggtgaccgcgctgctgggggttgagggacgcgttgcgagccccggatacattgtaccctgggggtacatantgaaggatgctgtacctgaaaggaaaagggcatctccaaaaggggacttcgcgggtggaatttccttccaaaatcctcgaggaacaaggtgtatttccgacctggattaatgaatcccccctcctatcccgcacttcctgtggaaacagtgtcaggatgtggcgcggacctatgtgcgtcccttataccaggacttgccttcaacgctgaaggtgaaccctgggtcatcctcgctgtattcaggcggcgctgcaaaggcttctgggcagccaataggcccttgagcgcctcagccccatcttgcttcagtaggcaaacggacgggtgtcttcatccacctcctaggccgtggtctacccttcgttcaaatgtttcttcctgctagctgactgtccaggtccttagctgtatcacattgttcaaatgtgtgtgcgcaggtgtttctttttcaactaatcatgcaggaagtggcgggatgccttactgccattatttgctgagtatttccagatggaactgtagttgatagccaataaatttggtacgtttttatcgggatgcgcatgccatagatcgtccctgagataatgctttgcaatgtggaacctgaaacacctatgtataagcccaagcctttcattaatattaactgtgagacccctggaagctactactttgtgtgagcctgttttctccgccctcaaacagtggatataatacccccttgcaaggctgtgagattaaatggataactgtgcataatgctaagcatggtgtctgggacgtaagaggttccttatatcccattagttcactaggtgggatcaccaagttgaaattcattttttaatattttgcttgttggagtactcacaactcaacttctctggctaatttgatgtttaatttgaaaggtaatgacactattttgtaacatttttagatgcttaagggaaatttgaaatgcaaagtggaacaacattaaaaggaaactcatttgtaaaataaagaaaaacaaaatctatgcaagccaagaagtcatgaatgctgaggaagcaaaattgtg

SEQ ID NO: 476 - DNA, 332 bp, Homo sapiens
  misc_feature: Incyte ID No: 012417.1
cagaagagaaaaagtcaaagtcataactacatactaatgagttaattaaaataaaaaaattacaaaacacattaagggtagcaataacatatatatatccagtttgcttcaatatcaactagttttagacataactactaaaagactaacactaaagaataaagtttaaagtgttcctggaagctgagctaccaaagttttcttattcaatacattttcttattggaggaataagtttaagcccttttagtgatgagacagctttgttgccactagttgtatacaataacaaccagaacctgggctactctaaaagtctccaaatcattctt

SEQ ID NO: 477 - DNA, 597 bp, Homo sapiens
  misc_feature: Incyte ID No: 237754.1
aaaataaataaatagaaagagagagagaggaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttctaacaagaaaaaaaataaaagcacattgtcatttt

SEQ ID NO: 478 - DNA, 2039 bp, Homo sapiens
  misc_feature: Incyte ID No: 1256053CB1
agcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggacgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtcaacaaaaaaaaaaaa

SEQ ID NO: 479 - protein, 325 aa, Homo sapiens
  misc_feature: Incyte ID No: 1256053CD1
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 480 - DNA, 1154 bp, Homo sapiens
  misc_feature: Incyte ID No: 238391.3
cggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcgggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtaaaaaaaaaaaaagagccgctcgcgatcta

SEQ ID NO: 481 - DNA, 1521 bp, Homo sapiens
  misc_feature: Incyte ID No: 201945.4
ggctatttgaaagtgtggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataattgctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcggtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataagggactttctctcccttttcagccctctctgtgcagagaaaagatgtgagtccgcttgatgaattctaatgctttgcttagagctatgagaaatgtttgttttaataaaaacctacagtccaataatgaaaaaaaaaccaaaaac

SEQ ID NO: 482 - DNA, 674 bp, Homo sapiens
  misc_feature: Incyte ID No: 235725.21
tgaaatcggggaatcgggcctctgccggcgccctggcagcggcgcggggcgtggctccgggctggattggtggcgcctgggccccgcgagcgcctgcgcagtggtcaaggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaa

SEQ ID NO: 483 - DNA, 917 bp, Homo sapiens
  misc_feature: Incyte ID No: 406031.5
  unsure 869, 873, 901, 910, 912: a, t, c, g, or other
gcgcggtgctagggttccgtctggactggcggtgacacatcgttatctgccaattcttcgcagacgtagagaacggactgcagagttaataaacgtcgaggggaagctttgatgcgccccatttggccctgagagatgccacgtgatcgtcattttaaatcctttcctgggcttcccgatggactcgagtttttactatgtgagcatcccggtgcctgcacagcaaggactctcattgggttccacacgtgctgcgcagatccctgacgcagcgttcactgaacctcaactgcaggagcttcattcctgaggacgctgttaccaagaatgacttgcctcttgaagaatgagtttgcaaagccggcagttagattgctgatgtccaaagtaagtatgtgtagcatcactaaagagaaaattcaggattcctggaaaacagttatgggctctctgcagtgttatttttgtaataaaaaacatatagcatatgtgaaatacctactgggtgatgcaggacacatagaaggctcgaaattaatgtgaatcattctcgtttttctgactgtcattaaaagtccccatttgtattatgtatgagtggtatatcaatatctaaactacactttattgtaggtcccaaccaacattagtttattgacaaatgtttaagagcagccaaaaattcatagaatacctatgattcttaaatcatgaacactcccataactggtatatgtttaggacatgaaaatttccaggctgacaaataatttcgctgtcatcggtcaagactccaggatgatattctgagccatatgttaattttgataaccacctagaacaataaaaggtaaacatgctaccatctnctanctcattgcaccactggattctggtacanctaaaaatncnactta

SEQ ID NO: 484 - DNA, 5184 bp, Homo sapiens
  misc_feature: Incyte ID No: 998941.1
  unsure 3781: a, t, c, g, or other
ccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatcctttggtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtactttttttttttaatttttaagctcttaactcacattgttatgcttaagatgataaacatatatcctctttttattgctttgtctatgtttcatatgaaacatttcagaaattattttgataagtgttgctggaatctgcaacgctgatgttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcancactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaggaaaaaaggatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcagtgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatgcagagaaaattgtccttctagagcatagagtcccaaaactcaattctggttttcccc

SEQ ID NO: 485 - DNA, 2201 bp, Homo sapiens
  misc_feature: Incyte ID No: 243985.10
  unsure 42: a, t, c, g, or other
gaggaggagaaaaaacgagaggtattaaataatccagtgaanatgaagaaaatcaaagaattgttgcaaatgagtctggaaaaaaaggagaagaagaaaaagaaggagaacgaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgtgagtgtgggattcactgggaaataacctgtgactgtgggggcctggtcccagcaggcatttgtttttgcttttggtgatgtccgtccattgactttcccaaatgtctttgctttggtatttcctttacatcattttttttttccacctcaatgtaaagctcaggcatccaaagccacatatctgtaggtgtattctgtgctttgggagctctggggtgagtctaacatcaaaccctatacctttgtttttctcacacttagattatacctctaagaccattagctcatcttgcattgtttgagggattcagtgtaagcccctggaccaaaaaggctttttcctctttgccttctgtgtctgctacaggcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtact

SEQ ID NO: 486 - DNA, 745 bp, Homo sapiens
  misc_feature: Incyte ID No: 481779.1
gcagacactgccctcgcccgaggcggacgcgctcgccggcagcaagcacaaagaggagaaggctgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgt

SEQ ID NO: 487 - DNA, 1701 bp, Homo sapiens
  misc_feature: Incyte ID No: 982633.1
cacacacataggacacaagcagtgacagggaaagagcaagactttataaagtaagcacagaacaaggtatctttctaatgaggaggaggtgttggttctgggaaggaagcttgggatttgggtattcaggatccagaagtgagagagcctgggaagttcaggaaccagagaaagaaaaagccttgcccattctcacccatgacactgtgctcagcaggtactagcagacttcaggctctgtgactaaaaggggtcagaccagttgatatacccacagctgccatgtaaggatgtgtgtggacttcactagggaagaacggtgttatgaaagaaggggcagaaaaactcacctgttggtctgcatgtagaggtttattgtcctgaattcctggaggttcagtgaaaagcagaagattgtcttttacacatgttgagttatgcccccatatatgtggttgtggtaaagaaagagggtgtgttgatgagaggtcctgaaatgcattttcctaatactcagcaggggcttctcaagaaggatcttccctaagaaagaagctcagagaacaaaaatggaaaaggattagatatggcactttcactggaaaaagtcatgttattcattgattgttttgtcatctcccgccttaagtgttgtttttaggatgtggtaatctctgaccctgcctaacacatttcccaactcacccatagccttcccttaacgtcctcccatcttcacgctatcacactgtgacccagtgaattcgaacttgtgaagttccattcgggggatcatatgggaagggcttcacacccagacatagattatagatgggaagtgggccacatggtgtcagtgaggcaagtatgggtcgtttagggacaatgcactgtcagatctttgttgaccatgattagagaaactgtgcatattagtagtgaattaatgtcaggaatacctgacaaatcctggaaaagaagattgatgagaggaaatgtgttctgcccaactgtataatgcatttgaagcttaaaacaatgaatcagtattgatctggccacaaaatattaatgatttgaattaaaaagaaaagtttagaaaatgatagctttgacaaattaaggtagcatttcatccacacgatggagtgtgttttattcagtaattgatttaaaaatggaatcaacctaagtgtctaacaggagggagttttataaattgttcacagaacatctgttccaaggagaccttgatgttcatagatttgtaaagaatgctgcttactagcacactgactgctctgcaaatgtctgagggttcctccacttggggcaagttgggggtttgatcgcagagtaaataaatggtgcattttataatgtaatatattctagcaagatgcagcccacaaactgtatagatactcttatgtaccacataaagttcatctactactttaaccagaacttgatactgtatgtatgttttttttttttagatttggataaaatgacaactcattgttatttccagttcacaaagtaattgtgaggctgaataaattttattattttatagaccttttttttaaatgaattttcctatgaaactcatttttgagtgtctattagatgctatttatattctgtagtttaattatatgtacgccacacaaacacacacttcggtgtcttattatg

SEQ ID NO: 488 - DNA, 3928 bp, Homo sapiens
  misc_feature: Incyte ID No: 2120743CB1
ccctcgagccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaattttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaatttttc

SEQ ID NO: 489 - protein, 697 aa, Homo sapiens
  misc_feature: Incyte ID No: 2120743CD1
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 490 - DNA, 453 bp, Homo sapiens
  misc_feature: Incyte ID No: 026914.1
tggaagaataaaacagcccattagccaaagcaacattaacaacaaagcaatcctggaggcctcacattacctggcttgtactacaaagctacagtaatccatattacatggcttgctacaaaaatacacatgtagaccaatagaaagaagagaaagccctgaaataagtttacatttctacacccaacttttttctgacaaagtcaacagaagtaaacaaggaaaaattgtctatccaacaaatggtactgggaaaactggttaatcatatgtagaaggagaaaattgaaactgtacctctcaccatataaaaaatgtaattcaaaatagattaaaaacttaactgtgaaacttaaagctataaaaatcgtagaacatcaaaaaagtactcttctagtcactggcctctggaaaggatttatgactaacaccataaaagtgaatgcaacaaaa

SEQ ID NO: 491 - DNA, 3758 bp, Homo sapiens
  misc_feature: Incyte ID No: 199121.14
  unsure 2921-3105: a, t, c, g, or other
tcagggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaagtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggctgtcactgaaatttcatgctccattctgagcactatgcttcaagaggcagtgaggcaaactggaacatatttaggagggagcgtccttgttgcatgaaaagtgattgtaggatagtgacctggtgaagaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatacttttttttttctgatgtttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaagaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttatttt

SEQ ID NO: 492 - DNA, 553 bp, Homo sapiens
  misc_feature: Incyte ID No: 1960207CB1
tggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcatgtgaaaaaaaaaa

SEQ ID NO: 493 - protein, 130 aa, Homo sapiens
  misc_feature: Incyte ID No: 1960207CD1
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKK

SEQ ID NO: 494 - DNA, 2465 bp, Homo sapiens
  misc_feature: Incyte ID No: 391185.13
  unsure 157: a, t, c, g, or other
agaacccggcggtcacgggaatatccgtcgcgccgagaacgctggttagtcttgtttcgggttccggctgcgttgggcttgctgtgcggctcgctaagactatgtgcgtccgggcctcattctgacagctactgctgctcgcagccgcctcatcgcnccgccccaagcgcgggcgggttccagctccgggacgacgaccacagacgacgaccacgacgggagggatcctgatcggcgatcgccttgtactcggaagtttcacttaccatcgagcactctctgattccggaggagaggctcttcgcccacaccatccatgcaggatgggctctgacctgcccagtgagacggacttacagcatcctgggctgcgagctcatccaggccagccggcattctcctccggcatgccgcaggtggcgatggcaacgggggcaggtgttgtttcatcgttttttctactccaaatctttcgtcaaacacagtttcgcagattgttcgctatggcttgtattaatcttgcatcaaaaatcgaagaagcacctaagaagaataagaggtgtgattaagtgtattccaccacctccgcccagttacgcaggacaacaggactccaagccccctgatccttggaggagaactacattaacaccaagaaatcacgttcatcaaagcagagaggagggtgctaaaggagttgggattttgtgttcatgtcaagcatcctcataagatcattgttatgtatttacaagtcttagaatgtgaacgtaatcaaacggggggttcaaactgcctgggtagtccatgatggaattacatgcaatgacagttcttcgaaccaatgtgtttgttcgatttcaaccagagactatagcatgtgcttgcatctacccttgcagctagagcacttcagattccgttgccaactcgtccccattggtttcttctttttggtactacagaagaggaaatgccaggaaatctgcatagaaacactcaggctttataccaggaaaaaagccaaacctatgaattacctggaaaaagaagtagaaaaaagaaaagtagccttaacaagaagccaaattaaaagcaaagggattgaatccggatggaacttccagccctttacagaccctggggtgggattttctccagcctccaagccatcattcaccaagagaagtaaaagcttgaagagaaatcaccaatctccattaatgtggagaccagccaaaaaaagaacctgaggatagacaacaggcttccaaaagcccttacaatggtgtaagaaaagacagcaagagaagtagaaatagcagaagtgcaagtcgatcgaggtcaagagcacgatcacgttctagatcacatacttccaagaagacactataataataggcggagtccatccgggaccttcaggtctgcggatatcaaaaccagtgtcccgcagtcacagtgaaagccctcgaagacatcataatcatggttctccttcaactttaagggccaggcttaccaaagatgattaaaaaagttcaaacagacatggtcataaaagggaaaaaatctcgttctcgatctcagagcaagtctcgggatcactcagatgcagcccaagaaacacaggcatgaaaggggaccatcatagggaccaggcgtgaaccgatctcgctcctttgagaggtcccataaaaagcaagcacccatgggtggcagtcgcttcaggacatggcaggcacaggcgctgactttctcttcctttgagcctgcatcagttcttggttttgcctatctacagtgtgatgtatggactcaatcaaaaacattaaacgcaaactggattaggatttgatttcttgaaaccctctaggtctctagaacactgaggacagtttccttttgaaaagaactatgttaatttttttgccacattaaaatgccctaaggcaagttaattttcccctaattaaaaaccatggtcaggttcaaattgtacctttaattatagggtgtgtaattgtttatttgctataaggaccttggagcgtgaattctgtaaaaatgtatcttatttttatacagataaaattgcagacactgttctatttaagtggttatttgtttaaatcgatggtgaatactttctttaacactggtttgtctgcatgtgtaaagatttttaccaaggaaataaaatacaaattcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaa

SEQ ID NO: 495 - DNA, 5080 bp, Homo sapiens
  misc_feature: Incyte ID No: 206866.1
  unsure 2468: a, t, c, g, or other
gcggcggcggcgaacgccaagacgttccaagcgcagctacccgcacgccaagccgccctactcgtacatctcgctcatcaccatggccatccagcaggcgcccagccaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaagagcatttctgttatttttttttcacttaactaaatccgaagtgaatatttctgaatacgatatttttcaaattctagaactgaatataaatgacaaaaatgaaaataaaattgttttgtctgtggttataatgaatgtgtagctagtaaaaacggagtgaaacgaaattcaagtaaacgtgtataacgttgatttaatatttccaagagttgagatttttaagattctttattcccagtgatgtttacttcattttttttntttttttttgacaccggcttaagccttctgtgtttcctttgagccttttcactacaaaatcaaatattaatttaactacctttcctccttccccaatgtatcacttttctttatctgagaattcttccaatgaaaataaaatatcagctgtggctgatagaattaagttgtgtccaacggagactcatgaactctcttctcattaaaagagaaacgaaacttagccatcagggtagctctggaggaggtgggaggaggggagttaattcactctcgcaggggaagcgttgtaccgacaggacattttagggtagccgctattttgcattttgtgaagattgttttaaattttgattcaaaaatgtcgttcctaagaacttaaagttgataatttgtttccttctaaggagcttttaaatgcaacttcacactccatagttgcttgggatcacaaaatcattaatctcctttgatagcaggctcactttccagtccacctatttctttgtaagtcttgttcggattgacatcaacaataacaacaccagctcaagcagaggcctgcctgcctgagcccttgtgtatgaactccatcctcaccagggcttgaacttggacagcctttactttgatcgccccactccacaccgcggacaagataaaaagagccgtgtgagtcgcttaattatcgcgtaattgcctccccagatgagagaaagggtgccatgtagcacttgaaaaaatccagaaatcccaaacccccactcacttcagttaatgaaaggaggaggggagggaaattactggtttgaataatttcaaaccctaatttggagacctcggaaggacatcaaagtcccaaagagaggaaaaagcttccaatcccaacagttactcttatttacataaggtaaacaaattcagcttccaaatgtaatataaaggcgtgggcttgggcctcggaatcccgcccccactgaatctaagatgtttaacttctgtgctgtcctctctgtgatgttccctttctccttttcaacgtattagaaacatcagcgccttgccttcaccccaccaagcttaagttggccttagctctcgctctgttacttgccggagacattttctagttatgcgggggacgggggcactttggagacctgcctcgggagctggaccgcggggagcctgcaggcccagcccctgctttgtgggcttctcgcagttctcagaccgcacactccgccacctctgggtgatgcgacctgccacccgcgcgttaggacgcgcgcgggttggcggccaggacagctggttgccagggaaggcggacagagcaggacagcaagcgtctcgaggtgacaagtgcagatagttcttcattgtttgggcattttcccttcctagcgaataaatctcctgttgagcccgggacctaaaagtcaacaaagaaggccagccgcctcgttacggctcctgcggccccggcggcccgcgttgccgcggctgctcccgctgcgtaatcccttcctcggaaacccggacacacaaacacccgggcgcccgggctggggcgccgcgcccctgggtcaggaagaaaacatctgtggttccgagggagtgcggagaccctgcctgagggcgccgccttcctgcgacccccaccccatccccttttcgtctgggtgtttccacatttcttcacctcgccagctcccgaagaccaggccggaaaggggctgctgaccgtcccgccgcggtgctcctgctcgctggtcttaggaatttcgcccgagatgggggaggggtccccggggaggggagggagggggcgaagaggggcgaggagggaaagccttcctcctgacccaagtgtacagctccggtggcgctcggacccaccaacgctaccgagcaaacatttttacaaaaaagaaaaaaacaaatgttttgggagtgagcataggacaggggaggggagctgcaattgttactctcaccttgcatttaggaagggcaggtatgaaacatttttaaggtgacaaaaacagaaccaaagatagggaagaagaaaagctcaccagttctattcagcaaaaactaaacaactcacaggtgttcggaagtagaaggcagttccgtccattttctacatgatggctaatacagtgtttacatcaaaggcaaaatttaatttccattgtccctttgtgatccccctcatacaggataaactgatgagaattattagggaaggagggattaaaacaaacaagatcctagtaaagctcccaacctctgttttcattttctgaaggctagatacctaattgatttcactgaaagcataaaaacattatatttcttagaagtctaacagatttgaacgagccataacagaaaagaagtcctgaagtgataaaaatgtaagcccttgttttggcattttaaaaaattggtctcaattccacaaacatgcttaagtttctttgcaaaaaactgccgagatcaatacaaattccttccaatgctggccaaagtagaagacctgtcacccaaattaattaacctttcctcaagatcaattggttttctgttgatttagcagtaat

SEQ ID NO: 496 - DNA, 2376 bp, Homo sapiens
  misc_feature: Incyte ID No: 1330257.51
cgcgatctagaacgccaactctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgctgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgcctcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttaactgaagtgaataccaataaaaagaaaaccc

SEQ ID NO: 497 - DNA, 1711 bp, Homo sapiens
  misc_feature: Incyte ID No: 983942.1
  unsure 1706-1707: a, t, c, g, or other
ggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggaggggggggggcggacagggttggggggagcccccctgcccctcaccaccccctcccaaggccaggcagccattgtccctgccttcgaatcaccagcctcgaatttaaggtcttgtaaccaggattgccaagcgtagcggaagaccctacccggaccggccaagcacccctttaactggagacgaacttgataatgaccttcatacctctacagagattttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagagaaaaaaaaaaaaaaaaaccaagcatttccttttctttctaccaaaatgtgttgactgacccggaggggggcggtagggtgggggaaaccacacaganngaaa

SEQ ID NO: 498 - DNA, 543 bp, Homo sapiens
  misc_feature: Incyte ID No: 223416.15
cggggcagattagcgccggctactccccggtcatcgactgccacacagcccacatcgcctgcaagtttgcggagctgaaggagaagattgaccggcgctctggcaagaagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaagg

SEQ ID NO: 499 - DNA, 859 bp, Homo sapiens
  misc_feature: Incyte ID No: 005876.1
  unsure 255: a, t, c, g, or other
cgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcngggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcaccta

SEQ ID NO: 500 - DNA, 591 bp, Homo sapiens
  misc_feature: Incyte ID No: 303545.3
  unsure 50, 305, 481, 514, 516, 519, 522, 548, 570, 585: a, t, c, g, or other
ctgcgaaatactattctgtacaaaacttgggaatatgtactccttttgancagttgcttgtagcccttcgaggaaatcaaaaccagagaattggtatgtctatttatgtgtgtgtatgtgtgctttttaggtacttagaagcaatactttgttcatatatgtgtatctttccaaaatattattaatttattgttagaccttaatatataagccctgacaaattaactattgtttagaagtgtaggttttccccttgtactatattaaacagaacaacttgtagatgtccacatttttttcttgtnacttcttgtaactcttgtaacttctactgcagatagttcctgcccctcaaacacagatcacagtgagctactacaaattccaaaatctacattatttttgttgcagcaggctaatgttctctatgggaagagggtgggaagagtggaaggggacatttggggatgtggggagaagnatgagtgtcagaaagtggggatggtacaaattnanaanacnaatatgataatgtggtagattaaaantcagccatatctataataatantcaatgtaaattgtntctaca

SEQ ID NO: 501 - DNA, 382 bp, Homo sapiens
  misc_feature: Incyte ID No: 331571.1
gcggccacgtgactgcagctccgctcccacctcggcccgcgccccttccccgccccagctttcttcccgccaggccccctccacccgatcgccgcgcgctctccgaaccaaaaggcgacctcacgaaatgcccctttgagctcaaaggctagttacccccagggggcccttccactctcggggacaggcgaaacctctttgtctctgcctcggcctgcggcccccagcccagcctccgcgctttccctccgccagtccttgtcaatcaaacctggtgccaaacgcggcagctgaagttttcagggacacatttgcttctccccttgaagaaccagttacaaagcgtgatgtcctctctggggtcccatcagaacaaagaaac

SEQ ID NO: 502 - DNA, 3343 bp, Homo sapiens
  misc_feature: Incyte ID No: 2246292CB1
  unsure 57: a, t, c, g, or other
cttgcagcggcgcacgcgggatgggaggcggggaggagcagcgggaagagcggacgngcgaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcagcctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaaaa

SEQ ID NO: 503 - protein, 723 aa, Homo sapiens
  misc_feature: Incyte ID No: 2246292CD1
MRLWKAVVVTLAFMSVDICVTTAIYVFSHLDRSLLEDIRHFNIFDSVLDLWAACLYRSCLLLGATIGVAKNSALGPRRLRASWLVISLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGSVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 504 - DNA, 4144 bp, Homo sapiens
  misc_feature: Incyte ID No: 411449.1
gaaatgctgggtgaaccggaagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaataaaaaaaaaaggcaagatgtgtattccttgcaaaagaacaagcctgctaatttgggaggaagggaaggtcaggacccaaatagagccaatttcctggagatggcctgttctactggcacattttcctgagtctgtgcttaaaacctttcaggtactttcagggcacagaaacaatgcatgctaaaaaatatatggccaaagctccttccaacaaagatttaacttgctccaggaacaaaataattgctttaggttaagaggtagtaattagagactattcttctccctttagacccccactaatcccaaaaataaaaatacacaccatggaacactgacaattgagtaccaagtattaaatttaaataatatcccaaaaggtagcacctgctcatagttaagggatagggcacctctgtccaaccatgtattttaagaccaagcactttattagaaatctgtcccgtaaagagaacaaatttagcagttagaactaaaaataccaactcatggaatgtcatcatagttgtatctactgctggtgtcttatactgtcatgctactgtgaagtaattccgtattacacatcaggaaagtaaggccaggaaggtgaacttacctgctctgggcctcctcataaccaatgagtggcagaaccaagaccgaaagtctgagttttcaagctttttactcagcccattaagtgacaaccaggaaaaaataatacgtcacttgatctttcttcccacagtgaaaaaatgcacttgcgttctgccagccttctttcagtgatatgttggtttcttaagaattaacatactaaggatcacagtatagcaaagggaattaatgtggtctctgcttggtgctttaatccaaaggcagactgggaagaagtggatatgtccctgagaagcctgtttcattttggaaataattcaacttagtttcagggaaaacctaaacttcatgaacagatttagaaatgaacaagacaacatttaaatggcagttgctgccctgaatccagagtaccattagacaacatgattatttcctaattcttccccatttggtacaggattatctatgacaattgaagaaataatttgaacacaagtccatttaggcaaatatacagcaatggaactagaaaaccatttactatccaattaccatgtttaggcatatactaagtatagctataggccccatccagcagggaaatttgcaaaaactctagtcccttctaataagttgtctatggatgttatcatgaagggaaaaggtttgttcttaggcccatgtcctgattaagtaaaccggaccacacctgtggggtcaaaatatagaaggatcaaagcaccaaggctaaagacaagttagttgtgacacctgctatataaacagagagcaatacagtgttgccttgtcataccatcctacatggcattagttccaatccacctcttgatcccagcccttgacttccccaaattcaatattccgattggtgtacccaggtcactattggatccagctttctgggtcctttaatttgctgtatatgcactctacactaaacgtaattaattgcaaaaaaaaaaatctcttcaagaaaccttcataacaaaataccagattcccttttaacaagaaaaggggatcaagcttaacgccaaaatagaagacaagacgtctgtcagaacatacagatggcacaagacagctctgacctcaggccccgtgctgaacaagagtcactggcaaaaccacaaggagtaagaactgtaaatatccacagtcatgtggaaaacaaaagtgtttcccatttagtcatcctctgagctctcagcagacctttcatctgtagctactttccaatttgtgcgtttgtttgtcctctcctgtatttcattgttggctacagaggtatgggcttttttctctctctttttccttttggttttcttagtgtctctttcctcactttcctcagaactgctggatgctgaatcatctgaatgtgaagtgttactttctgcctctaagaataaagcaggttttttgagagactttttcctggattttttcttgcgtttatgtggttgtttccctttccttgtaccagaagccccagtttcttctgagaactcactcgaggaatctgctgttatatctgtggcttcctttttgcttttcttctgttttttgtgtgacctttttttctgcttttttttgtgggatttctttgacttcttgtgtttgcgggattcatgggtagatgactttacctggggagatgttttcttcccgttggtaatatcttgctgatcactactgtctgtttcaaattcttcagggtataactctttataaccactgtgaccccatctgtctggcatgtttgcttcataatcatagaactttttattccaggatttagccttaagaaaatcatcttccagtgtcccagaaatttcattctttggcctccaatagtatctttgactttcttcatcaaaaccatcactgcgcatccggcttgaactgctgggtagcattttccttttggtcccccggtaagcatcttccatctgtttttccagttctcttattttccacatatctgattcctcctgaatcttattgtgagcatctgtgtgccggatgacattcctcaggaggaccttccccagtggaatccgggacattcttcaatcccttgatcctgaggaaatcaggcatcttgctagtgagacgaagaaccactccattacaagatctcctccgacccaggaagccaaggagtcagggctcaaaggcagctctgcagcttcacccgagtccttcgtgaaaacgcagccttcccactggttactctgccctcacctgtggcccaggccactgccgcgtttcccccagcccagaccgacaggcagatctctctcccggactgaggccggaggctgagccggggcggaattcggacagcccggttgacctgggcattccccgctcacgctcctctaggacgaaccccgggggtaagtttcactccccagaaaggctgggaacgctttggatggctacggccttcggttgggccccagaaagtatctagggagcctgaagcgggggttgaggtttccaagtggaagacagaggaaatatccccatctttgtcaccgggatccctgttccccagcggcctcggagctcccggtaaccttccctccaaacgccctccccacacaaatacacacaaacacacccataccgtgcgccgcagcctcgcgtggcggggggtagggg

SEQ ID NO: 505 - DNA, 2990 bp, Homo sapiens
  misc_feature: Incyte ID No: 409853.3
gagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctcggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctatttcccttggggaatgccatatttaattcaccagcagtaatcctttaataactggcagagcactttattcttctggtgagctgcctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatataggtataacaactatttacaaaggcatttacattgtattaggctattataggtaatctagagatgattaaagtgtatggtaggatgtgcataggtatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatgagctctcctttttgttgttgttggttggcgagtggtttccatcaagtcatcatgggaaaataatcaagttccatattcacaggttaggataggatgtaatgattctcagaagaacccttctagtatgatatttgcttatcaaaatgtctcagaaacaaaatatttgaaaatactgtcacatttattgtatttctctctgttcttatgccgtgcatgtagaatgtacccaatgtttatgaattaatagataaataaggtctattgtcttttgaaaat

SEQ ID NO: 506 - DNA, 5284 bp, Homo sapiens
  misc_feature: Incyte ID No: 6301537CB1
gcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagcttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 507 - protein, 1285 aa, Homo sapiens
  misc_feature: Incyte ID No: 6301537CD1
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRSLDSYPVTSKNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 508 - DNA, 2001 bp, Homo sapiens
  misc_feature: Incyte ID No: 1398801.9
tcttgtacaaggttgcttgcaacatgatgatgaagaagaatcaaaataagaaacactatggaactattagaacattgcttcttaattgtctgatgttactggacaaaagtagggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagaacagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttccgctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaagg

SEQ ID NO: 509 - DNA, 1459 bp, Homo sapiens
  misc_feature: Incyte ID No: 1398801.5
ctgactttttcagagtaaactgagatgcagcagttcttgtaattcaggaatccatgtttaaatcctaggtagttctagctctagagacggcagtacaacagtggctttagatgtgtgtttatgacacaggaaggcgcttaggccgagcttgaggaacagaggaaatactgcatagctccttctgtgccctcacccggctccactgcattttcttcatggccgtccgtctgtcactctcttgtttactatggtttcccccagtgcctcccctcccctcccccaaactcctacctcaataggatgcaaattccataaggcaggggcttctttttgcctgttttgttctctgtcaagagcaattcctagtacataataggcattcaaatatttataaaaggaatgagtactggatttcattgatgtattgaaataaatgtgtagaaacaggcccatgagcaatatgtaaaagaaggcaggtctgaacccggcaggagaggaatgcctgctgctctgtgaagagtgactgttgggctgtcactgtccggttttctggacctctgaattgtcggtaggcattgctggtcccttacctgtctctttttcttttttaaccctagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgt

SEQ ID NO: 510 - DNA, 713 bp, Homo sapiens
  misc_feature: Incyte ID No: 014538.1
ggccaagttttgttgcactgattttcaagggctgattgagggccattattaagaaaagaggcattacagttgcgtacagttcttgaatatcatcttagtgtactgctaaatcccattatgaagaattcattggcagtctgctgaaaggtacactagcttataccacacacagcggtacattcttaagcacgttgttatccagaagttaatgactatctttgtttacgaagttgtatatagggtgactaagagcagctgaaaagaaatgcaacccatgccaagtataattagctttttccttgaatactggaatcacccgtttaccctagttagaggcctttgatatttttggtggttgctttctagcacattagctatcagccactcttctagaattgcttaacatgatgggctttgcttgaaagcagactggtaacctatgaaaacatcacaagtattgatgattttcaggactagggatcacaactgcagtttcatatggttggatggagtagtctttttgtggaggaatttatatgagaatcttagcttactgtctctttggtagtgggtattggcagggtagaaaaataagattatggattttctagtgttagcaatgtatttgacagctgagaagaatggtggcaagacttatggtaattcaagttcaaatttactttgcagtcagatgctctaccactgagctatat

SEQ ID NO: 511 - DNA, 792 bp, Homo sapiens
  misc_feature: Incyte ID No: 014007.1
  unsure 687: a, t, c, g, or other
gggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaattatagtaataatccctctgtttcttatgtttatgccaacttcaacaaaaagaaacttgactaagagccaatataagaatttaatgtgtaattaagaaagaactctccaccacggggaatgtgaaaggtatatgagtcccttttcacgatgcgatgtcatgtcttttaaataagccatactttatgttcaataaaaagagaataagcaggattcgcaagagaacacaatccctttttaactgctgggaagatacttttagtcattaatgactggacgacaatttgggacacatatatggatattggccggtttgtgatgatgtgattgggcctctaagtgacaacattgttccctgtatagagtgagtggcaagtgcatttancaaattggccatcatggctgttaaatttatgagtctagaagtgtgcctctcaaacaagtatttgagaggttatcatgaagaaaaacaaattaaaattatctgctg

SEQ ID NO: 512 - DNA, 418 bp, Homo sapiens
  misc_feature: Incyte ID No: 239996.2
cagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatacaccaaccgtggaaaggattcacccgactcaacaggcactatggaccttcctgggcttccttctcccttgttcatggcaggcaacattggtacacaagggcagctttttctttttttaactcaagttattaatgtatctccgcaactcccacaccgtgctgacctgataatcactgctctagtgaagatcatgcaaatgaaaagcataattaattgcacaaatgatttaaaa

SEQ ID NO: 513 - DNA, 4234 bp, Homo sapiens
  misc_feature: Incyte ID No: 238403.2
  unsure 4018, 4020, 4033, 4036-4038, 4040, 4043, 4046, 4055, 4097, 4099: a, t, c, g, or other
gagccgagacagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgatcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtcatgtgtgtctggncnctgttttggggcnttnnngngangtngcccccttntgtgacacatcctgtcctaaaggatttgggcccttcccagcntntcaagtgcccaggccctcaggtgccttcttcaaggacctttgaaactgtgtatttgtaagaccccaaagaggacaggtacttaaacctcagttctctcttgaaacggctttcttcttatacaaggaaaaagtagc

SEQ ID NO: 514 - DNA, 2372 bp, Homo sapiens
  misc_feature: Incyte ID No: 234681.20
gcgggacttcctgtgtcgtatttccaaggactccaaagcgaggccggggactgaaggtgtgggtgtcgagccctgctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgcaggagcgtcagaagcggcttccctacgtcccagagccctattacccggaatctggatgggaccgcctccgggagctgtttggcaaagatgaacagcagagaatttcaaaggaccttgctgatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttcaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaagtagatcagcattattaaagaaacggttcaactttgtttcttcccttagtattgctgacaaagtatctgctgtagaatacaggaattacttagaatagaaacatagtcatcacaactgttactaaatggaaaagaaaagaattattgagttaagtattcctgtcaatacgggaaacactgctagtaccttatgttggtgttagacctctctgccctacactgagaatatagttttacacaggagcaaggtttgtgaagcagcatagtgaggtagctaaagccatgggctggctctaaaggctttaaatcccagccatgtggcttagctgccatgagatgtgcatttgagaaatgttgtcttcttttgctgttcaactccagattttcagatgataatgtgattatcccagcttaagttgcgtccacttctggtctagtgaattgtggaaggcagttttagagaaaggagtcatgagtaacatgaacagcagttggctatgtctttccagttctctgctgatgtcagaaagacccagaaataccaaggagaaaaagccatcttagggatctaaggaggccctatggaaagttactaccttagacatttgaagatagcttactgcttagtacatacactgtaaacaacgatctcattttaaatgagaactttctcataaatattttacaaatgaggtcaaactagcataaagccatttaaagagattatcagtccaatatgaaccagttaagtctttggactatccctttcctccttgactactgctt

SEQ ID NO: 515 - DNA, 1467 bp, Homo sapiens
  misc_feature: Incyte ID No: 228678.1
gatctgcattattattacatgcctatgataaatttaaattacctgagtgataaggacattctgattatactattgtaaaatgcccgcttgccttatatttttaagtggttgtttttcaaaagtgtttaaataaggcagtcatatttcaaagtatagagcaaaagtttttttattattatttttgagacagggtctccctctgtcacccaggctagagttgcagtgagccgagatcaagccactgcactccggcctgggagacagagtgagactccgtctctaaataaacaaacaaataaaaatgtattctctaaggacattttttttttggttactggttcctagagatgaaatgattatcttattttcagtaggcaaggtagtttaaatgcagaaattctgcgatatatgaatattgtgacatcaagaacagcttcatgggcatattctttgggaaagaggcaagaagaataaaagggctaaaagtattttattttcagcttatgagtgttgttactgcttcaaattgtgtttagtcacctgagccataaatcagttgtagtagggctattgtattttaaatatattttttgttctccaaggagacttatctagtttgccacctccttgcctattgctctgatatggttttccctccttttttatttattgcacaaatatctaacagttaaaaaagaaaaatttcagtaccatatcaattgtctttcatattttgtgttcctcctttccagtgcttttctatgtaagtaaatattctgatgtacttgtaagtaatcactcagagcataatgtaattttgtctttggtgtcttaaaattttgcagccaggcaagagaggttcacagggaaggtaggaacaagtgattattcagtgtgaggatgggaagaagatcaaagataagtaagggcaatgattgtatccttcccgtgtcattgcccctagtccccaagccaccctcctgcaatcatgagtatagtggtgtattgtggaaggcagcatgcccagttttccagtttcaaaatatattatttagcagtgaggcttaactcccagtaaatgaaggggtctgtgagtaggggaacccttcagactggttatattatgagctgtagaactgttgccattttgttgttcccagttgtgcccataaagagatgtgtctgagctggagacttaggctcagatggggaacaaacagccaagtaccaaccttagtttggtccaataggtgaattttagcaactctctaaactcagctctatacctgtaagactcagaagtgatacatatagtgatagaaaaaaatactttagaaaatagaaaacaacttactggttactctgctaatgtgatggaggttgcagaatggaaaatgaatgaatgcaaaaaaatacagctggattgtgtgccacaagtttattactcaataaatattctgtggtttg

SEQ ID NO: 516 - DNA, 582 bp, Homo sapiens
  misc_feature: Incyte ID No: 233218.22
gcgaggaaacaactcgagctttgaggcttcctccaactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaact

SEQ ID NO: 517 - DNA, 2733 bp, Homo sapiens
  misc_feature: Incyte ID No: 233218.18
ggcttacccgggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacaaaaaaaaaaaagggaaaaaaaaaaaaaaa

SEQ ID NO: 518 - DNA, 610 bp, Homo sapiens
  misc_feature: Incyte ID No: 006320.1
  unsure 143, 152, 175, 513: a, t, c, g, or other
acaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtnacaaatganggaacagaggcacagagattggnagggacatgctcaaagacatggagagcctgggcagaggatggccccagagtgggtggtgcctggccctgcttcagcctgacattgtccaagcctcccccagcccactccaaaaatggccaggccccacttcttcccaggtgggctacattttctgctgtcccggtcccacttccttaccttttctccttaaatctgatttcactgtgagggtgggaggttgggcagaggggtgaaaaccctcttccccttacttggtaagcacatacaattttttttggttttgtcacttaaaaaaaataacatacctggttgatcctgccagcagaaaaaaaaaacnaaaccaaagggtggggattacaggtgtgagccacgcgcccggcaaaattttcaccttcattatgagtgagatagagcatctttcagatacacatcat

SEQ ID NO: 519 - DNA, 370 bp, Homo sapiens
  misc_feature: Incyte ID No: 015433.1
aagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttatggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgat

SEQ ID NO: 520 - DNA, 725 bp, Homo sapiens
  misc_feature: Incyte ID No: 1600311CB1
  unsure 677, 679, 692, 694, 700, 703-706, 711, 716, 722-723: a, t, c, g, or other
cacataccagcgggcagggagagatccggggaggattgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctgaaaaaaaananaagaaagaaatananaagaanaannnngagangagangggggnnta

SEQ ID NO: 521 - protein, 79 aa, Homo sapiens
  misc_feature: Incyte ID No: 1600311CD1
MQALRVSQALIRSFSSTARNRFQNRVREKQKLFQEDNDIPLYLKGGIVDNILYRVTMTLCLGGTVYSLYSLGWASFPRN

SEQ ID NO: 522 - DNA, 1081 bp, Homo sapiens
  misc_feature: Incyte ID No: 335999.1
ggcatagagaggcggcgcgggtggggagagaaaaaaggaacgcaggggggagggggaaaagcagcttgcaggatgggagtttcttgcagaatttacaggattaaggagtttggggaagtcgcagagctgcagcggaaaggcaggggtctgagactacttttgagaagagaaacaacgcaaaacgatcgctggagggccagagccctggtcgaaggtgccctagcttttatgacctggttaattgtgtctcctttttatttttatttttttccttaccactactactactactacttttatttttttttaaccgatacactttggagagaagaagcagacacaggttcccacggcgtctgacgcctgcggagcaagtccagagccagctggactcgcagcctctggcccggcggcaccaactcctcactgggtcattttgagcgcgctgtgcccaccttttctgttgcgtgtggacgtggggaggatcttctaagtccctccaacgaaggcaagtgtgagactctggccctttatttgtaagaagcaagccttcagattgcagaagtgtcgcgcgggtcgccgtgcgttgcgcgagtgggaagatggaggaggccggcacgctgctttcgtggacgcaagtgaaccgggcgtgaaggcagggtgcgagctctgcccttggcccagccctgcgtgggcgccgtcccagattccgggcggtgcggggtgcagagatctggagagacttgcgggctccccagcgcaggctgctctgggatttcgttggaagatccggcagagccttggaggagagggcccgggaggctgtgtgtgcagcggaaacttgtacgaatgcccccacagcggaaatggtgcgcacgagtaatttctgcggtgcacccttttaaaaattgacaagtgaacaagatcaattttttaagaaagcaaaggtagaaaacaaaaggcgtgcgacttcttgactggcttgttcccgcctttcttccttctctatactcagatcagaaacttttctttaattgctcttattcagtgcgacaacttttaataaaagcatttgcatttt

SEQ ID NO: 523 - DNA, 1639 bp, Homo sapiens
  misc_feature: Incyte ID No: 197523.6
tgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcaactacttaaactgttcatgaataggcgtactttctgtatttaaaaatggcccctcaagcaccgttaatttacattccagttatttacatgataattcatgacattctgaaacttgcctgtatattatctgaaaaatggatttcttgaggaaaagatctgtttattgtatgtaaggaaaaattttacctgaaaacaaacaaacaaccctaaaactcagcaccactaccatttccagaagcttttttagcaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatacgattagatcctttaccttttaatatctagtttttccaaaaatgatagtaatatcttttgaagaactatgctttttcaaaagcaaaatcaactctgtataatagcacattctgatctttaaaaagtagagaatgtgctattatacagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcgtgtattctctcagacataccggtgtagatgccatatttctgatgtcttcttaatgtctgtgaaagcaactggcatctacaataaatcacacttagaactggttagaggactccctcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatc

SEQ ID NO: 524 - DNA, 239 bp, Homo sapiens
  misc_feature: Incyte ID No: 012833.1
gctcgagaaagagatatctgctttgcttatttgttgcatgggcagctggtatttaatttgagggataagttccataaaataattcatattggctcatttagtagcaaacatagtaatttgggttttaaacattgaataatttctaccttgttgaaataactgtggttccatttataagataatattaagaatgagtagagtaggctggtccgagtgcagtggtatttacaacctattga

SEQ ID NO: 525 - DNA, 1768 bp, Homo sapiens
  misc_feature: Incyte ID No: 1080598.1
  unsure 1758: a, t, c, g, or other
gcctttatggtggtggagtccgcccaggctgtgtgaccgcaaataaccctgtacaaagaggaatggagaatgctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggntctgaatacc

SEQ ID NO: 526 - DNA, 2047 bp, Homo sapiens
  misc_feature: Incyte ID No: 2239738CB1
ggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaaaaccagcctgaccaacatggtgaaaccctgtctctacttgggggtagcggggtgtggtggcgggcacctgtaatcgcagcctttcaggaggctgagacaggagaatcgcttgaaccctagaggcggagtttgcagtgagccgagatagtgccattgtactccagcttgggcaacagagtaaactctgctcaaaaaaaaaaaaaaa

SEQ ID NO: 527 - protein, 443 aa, Homo sapiens
  misc_feature: Incyte ID No: 2239738CD1
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 528 - DNA, 2748 bp, Homo sapiens
  misc_feature: Incyte ID No: 087074.1
  unsure 2475: a, t, c, g, or other
gactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaaggtggatgctgtcaatgcccgagtgacacatgagagctgtatgaattgagagaaaaggcaacaagtagcattcttcatcattcaagttctacctggacacaaaggcgaggaccctggggttccaacaaagctcagctcccagattctctttccagtttcatcctaagttcctagcataaacactatttattttctgcagcagtgtgttatttttgcgcacttatacaaaatggtagtactactgtgttgtggtttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaanaaaaagaaggctaaaaaattacctctttttaaattatgtgcaaaataattctggctaactgtaaaatgtattcaattttaggatttttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtcttaaaaa

SEQ ID NO: 529 - DNA, 270 bp, Homo sapiens
  misc_feature: Incyte ID No: 012039.1
tgaacatcgtctttcttaggtgacttcctccacatagttatttgtgaattgtaatattgtgtggcaatattatccaaaaagtatttgtttttattgtattttgcaatccctaggacatattaaatagctcaagtgatgggatgttcttcttaaaattcgatctcatagtctaaaatggtgacttgcacatgagttagcctcattaagtcctggacgaatggcaaatgctataatttcctgtctcacttctggatatcacagtgtcatctt

SEQ ID NO: 530 - DNA, 5506 bp, Homo sapiens
  misc_feature: Incyte ID No: 1730175CB1
ctggagcagcggcgcccgggagccgagcttgcagcgagggaccggctgaggcgcgcgggagggaaggaggcaagggctccgcggcgctgtcgcgctgccgctcactctcggggaagagatggcggcggagcggggagcccggcgactcctcagcaccccctccttctggctctactgcctgctgctgctcgggcgccgggcgccgggcgccgcggcggccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacggagcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgtaggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggacttggtaataggaaatggaggaactgctgaggtcctgtgaatgtttctgtcattgtactttcttccagaagcctgcagagaatggaagcatcttctttattgtcctttcctggcatgtccatccttatttggcctacgttgcaacgtggagtttgatttgatctggttttaaaattcttctatgcaatacgtgggtt

SEQ ID NO: 531 - protein, 1461 aa, Homo sapiens
  misc_feature: Incyte ID No: 1730175CD1
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNGAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 532 - DNA, 1669 bp, Homo sapiens
  misc_feature: Incyte ID No: 6825202CB1
ctagcagagggggagaggagggatgccgcagctgagcctgtcctggctgggcctcgggcccgtggcagcatccccgtggctgcttctgctgctggttgggggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgccgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcacgctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacaaaaaatataaaaaaaa

SEQ ID NO: 533 - protein, 524 aa, Homo sapiens
  misc_feature: Incyte ID No: 6825202CD1
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRRTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 534 - DNA, 570 bp, Homo sapiens
  misc_feature: Incyte ID No: 025613.1
cattcagcctccagagcaccagcactgggcactggcactgggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacacactggagaagctcaactataaatttccagcaacagtgcacatggcgcatcaaaaacccacacctgctctggaaaaggttgttccactgaaaaggatctacattattcagcagcctcgaaaatgttaagcctggatttaaaacacagccgtctggccagctgcctcgaatatctgacagcttagcaaaaagggccaaagctttccataggcgtgctgcacttgcttggtaaattaaacagcttttgtatcttcccctttgactttaggtaataaagcatccaaacttgtaaatctgaaaaatgaaaaaaaaaagggcggccgcc

SEQ ID NO: 535 - DNA, 1961 bp, Homo sapiens
  misc_feature: Incyte ID No: 3027821CB1
cgctcgtcagtggcttcagttcacacgtggcgccacggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcagggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgatttttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagataccctcgagccgaatcgctcgagg

SEQ ID NO: 536 - protein, 549 aa, Homo sapiens
  misc_feature: Incyte ID No: 3027821CD1
MKRPKLKKASKRMTCHKRYKIQKKVREHHRKLRKEAKKQGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 537 - DNA, 1832 bp, Homo sapiens
  misc_feature: Incyte ID No: 480736.41
gcaaatgtcttatttctaattgctatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaggttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagccataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgatttttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaaaaaaaaaaaagg

SEQ ID NO: 538 - DNA, 1253 bp, Homo sapiens
  misc_feature: Incyte ID No: 236943.1
ctggactttcattctcaaaagcaatccatatgtgccttttgagagcctggcagttatattcatatggcatatttagatcttagccaagaatcagacatagctctccttccctgttgcttttctccatcatccttccacctgccacccatttgctccatgactcctgcctttctcatttcctttcttgcatgcaaactaaaaacaaaaacaaaaagtcatgtgatttctttgtcctacttttctctcctctgagatgaatttttaattgtcagcaacaatctaattagtcctgaccagagcctgttctttctttcagcctatttgcttttgccttcagggttagtagctggcaactaatatccactagaactgaatcacccgaattatcatagggctgagctaatatcctggctgtagatgctatcataggcagaaagaaaattgaaaggcaagttctaccatgggcctggctgtaagcagccactgttaggtccagactccatgctttaaagttagcctcaagattcctggaaatttttacttaggctaaactagggaccccccaaaaggtgtcccagttatttttagtatccctttgttgcaagatagtataggatatggggcaaaactagatctcatgctttcagtagttaataaccttaacagttgtcatttatttaaggcctgtgctgaatgctttatatagtttttctcatttattccccaaaacaattattgtaaaaatgaaaaaaaaaaaaactgagtcacagattaaataacttgcccaaggtcactccgagagtaagtggtagaaccaaaattcaaaccaaatatgtcaggttccagagtgcaaacttttcaccactgtaatataagctgtctgcatatttggcacagttttcaccatttgttaagcatgtggcccaaacaatgcaagaaggatctattgagcaactacactgtgcccccagcattgcagctgagggaggaagggcagcattctgctttctgagcactgtgacttccttgtcaaagcctaacttctaaagagccatttacctaccaaaagattttgctgctgtaaagaaagccattgcctggtacatgaccatagcaagggttagcaaactgtgacccaccaccagtatggcccataagccatacaaatagtcaaaaaagaaatcaaaagaagaataatattttacgacatatgaacacgaacattatatggaatttaaatttcaatgtccaaa

SEQ ID NO: 539 - DNA, 973 bp, Homo sapiens
  misc_feature: Incyte ID No: 076636.1
  unsure 871, 897, 938, 948, 951, 953, 955, 957, 960, 965, 968, 970: a, t, c, g, or other
cgaggagtctatattcagattgtttcgccagtgtctctggttttattgctcaacgttaaagaagccagaactggaaatcatagcggacgcatatgggtgtggattgtacaagagacaatgcagaattctagtcagttgatcgtacacagggagccttgtcctacatcatgacaaaggtgaatgattgcacctatgtatgccttaagttatgttcatggcatgcgtgcatggggcacttttttttggcttagggcttttaggcagcccgattgctacaagtcagaggacctcagctccaggtcaaggctatagcaggatgcagaggaggaggctgagaggtgggcctccactaagttcaggctgcctgggaggacagagcctgggcaactgggagccactgagggcttttgagggccatgagatgatcagatgtgcattcagagagatcattggctggatcgtggaggactggagacctcgggagtctgttgcctcggaaaatgatagtggcactggagatatgaagaaccgagaggtcgaggtaattgtctggatgtttggggccagggagcagccatccgtgctgcctctgatgcctggctgacaaggagcctaggagaagagcatgttggtcaattggggagcttactccattccaggcaggtcaagtcagagcgacctatgggcagctcgatgaagatgacatcaccatatccttgattgtgaagctctgattttgaggaaggggacccaaagttagagatgaagatttgggagtcatcagcaaagtggttcttaaaactctaggaaggagtgtgatatgagtgggggtaaaaatgagaagaggatcttgaaccatgctctgaggacnaacatttggggaccagtgaaggcaangaaattcacaaagaaaatagaaaaaaagtagccaggcaggnaagcggtgtnccngntntnaanggaanccngngct

SEQ ID NO: 540 - DNA, 677 bp, Homo sapiens
  misc_feature: Incyte ID No: 076644.1
gttaaaaaagaactttttgttgtcaaagtatgtatcattggttcttcattgttgccacaagagtgataacttcatttatttattgcttatgttttctgcttgtgagactgcaaagtttagcttgtttgcttcttcccaataatgaaattaatgctgtaactatgcatctaagaatgctgcttactaccaattatgtattacttattatttattactaccaattatttattacttactaccaattattaccaattagttattacaactaattgtaattacagttagttattgcagaagtgtttctatcagtttctaatccttgataatttcaattattctggatttttgtaatatttaatatagcttttgtaattttgaggttacttccctcaaatttctttgtattaaatcacaactacatacatgtaattgatataatttaggaattgttatttgtaaaacataaattacagatgaccccaaattctccaaaactgcaatgttcagttcaacttgcttaccacacaaattgatggagaaagaaaagaactgatcatagtatgtttataaataaaacatttaacaacatttgagtcaggaagttgaattgactggtgagaaccagagattttatatgtaataacaaatgaaagtaaaaactggtttttatagttaca

SEQ ID NO: 541 - DNA, 724 bp, Homo sapiens
  misc_feature: Incyte ID No: 076699.1
gaactagtcccattgtatgctacctaaacaatgtgttgttcaaggtcagtaaatgaccatccttactataattctacgaatttgaatttcttaaggtccaagaactctgctttgaagttcaggatctaggttaccagagctagacaacatcttgacctataattctaacaggtacttatcagatacatgaaaacaaatgccaactgagtataggagatctcattttctacataaaggaaacatatatggctaaaaatgtcttttgatggtgtaaaaattttatgaatctgataaccacggggagggataatggaagtatgatttcaatctcccctcctccccttttacctttctttgcctatttctgagtatctctaggctaccaaatgtttcagtctgaatgtagaaaaaacaaaataatgagcaggaatagaccgactggcacaaaatgtaccaaatggaaacaatttccagacggaatgtacactgacatgcgcgacttactgtaaataattatacaaagcacaatacaatgagaacaagagcaaaaaaaaaaaaaaaaaaaaaaaaaaaggaaaatctcaatcggagaagaaaaaagaatccacttggccaagaggcatgcattaatgcatagtgaattcatggactttccttattcccaccaaggcttgtggcttcaggggtatgaataaacctccttctccttgcaaaaccctcacac

SEQ ID NO: 542 - DNA, 670 bp, Homo sapiens
  misc_feature: Incyte ID No: 238140.1
taaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacattagatttgggtgtcttatacactatttaatacgccaatgataaatgccttacaccataagaagaaagctaatcattgagtaaatgggagaaaagagatgattcacgtcactacagttgattcaacctccaacaccaccatgaatatgcataggtttgagcttttagctagattcctgagtgtaaggcatctattttaaaagtgc

SEQ ID NO: 543 - DNA, 1269 bp, Homo sapiens
  misc_feature: Incyte ID No: 019080.2
  unsure 1164: a, t, c, g, or other
ctaaatagcaccattaagtcttttgtcaaggtctgaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacagttgagctctttacttttagtaagaccgacagaaatgtagtcagtaaagcacatgtagtgataggctatcagttatgtctgatacataagacagaataatatttcacaattagaaagtaccttagagatcatcttgctcacagtagatcattaatatcaataattaaagatgaagcttaatccaccatggtcatcagtcaggtggggcttattctaaatgcttaatgtgtcttaagctcatttccttgttcatatttgggttgctacttggctaaatcctttcaccttagtaccctaagccagtttcctggcttgatactatttgataatgctctgctcaggaatgattatattgggtgagaaatggagccctggggttgtgtgttttggaacagtattcaaggatcaaagaaagttcttagtccagggttaatctgcaaggcatttaagccacttccatagaggagcccagattngtcggttaaactatattgataactgaagtcaaagctgtggttccaaccccgatttttccaagaaaaatgacgtctggttatcactttgtacacgagagggctaac

SEQ ID NO: 544 - DNA, 529 bp, Homo sapiens
  misc_feature: Incyte ID No: 274444.1
gtctggctctatatctagattctgcttgacagcttgggtcagtttttcccttatcctgagacttggcagcagtagccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatatgatcttaataggcttagagttctaaacctaacctgaccttggtgtttaaacaccctgtgccaagtggcaactacttcctttaaagggaaaaaaaaacctgaagaaaactaa

SEQ ID NO: 545 - DNA, 450 bp, Homo sapiens
  misc_feature: Incyte ID No: 279625.1
tgaatgagacacagcagatgtgagccttgcattcaaaggtgtttttttaaaaacaatttggaaggaagagaatgaagatatacaaaacagaaaacattgtgatgtggtagcaaatgtaaatttattatagacttttatacatttaaggaggtttcagtttgtgattcacaatagtggggaacttctcaaagcctcttctaagatacaagaagaagccataattagagcagaaaagagattgaatcaatactagtctgatttactattccatgttatcattagggaaatgatataaagaggagacatacagtaatgggcttttccccctgtgttgtaaatcagtccttctttaatcctttgattcctcttccaggcactttaaaccaggagagcatttactctgttaaatcattatgtttaacatggcatccttctatttgagcatctgct

SEQ ID NO: 546 - DNA, 5245 bp, Homo sapiens
  misc_feature: Incyte ID No: 1330220.16
gcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcagggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactcttttttgatgtgatttcgtgttttcttttgaaggtggagaaggaacgtgataaagaagtaagcgatgatgaggctgaagaaaaggaagacaaaaaaaaaaaaaaagaaaaagaagagaaagagtcggaagacaaacctgaaattgaagatgttggttctgatgaggaagaagaaaagaaggatggtgacagaagagaagaagagataggaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaatatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctacttttcgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttgaataacatcaaaacaacgtggacactaagagaacacatgtaactcatggacgcaggggatgcatgttgtctgcattcctgttttctgtgcctacatgtgctccaccccacacctgctgagtacatgctgggaagaccatgtcaacccttggagcagctagtgtttaaccatctcctgctagcgcctcatgttttacattttggcactaactgtcatccagatactcccctttccccctaaataagacactgtcacacaatatcttttaactcatctgtatttgttacaactttaagcagaatgtgactcgagcactacatttccatccacaagactgggtctgagttatttttgaacagctttacgatatgcttaggtaggcttttaactttgctcctccaaacaatacttttctttggaaaacaagccctgtggagagatccttccatcaagttgcttcagtttaacctatttctagaggactagtacatgcagaattgtcaactacagggaatgaaaagttcaaaaagtagatcctacaagatgtaacgaatacttttctaaacatcaagatacagctcagaacacttcaataacaagatttggtctacttaggcatccggcttgacagctaaacactttagaccacacaaagttaacatcatgttacatacgtcttacagtgcacgttaccccaatctgtgaaaataaaccaacatgaaactcaaaaagcattactagctctgctttagtgcctaaggtatcacagcatcacttagtagacagaaatcttatcttccccttaaagtagttgtcatgccatacagactttttaatattaacaaaaataaagaaaaacatccttgaaaatatattatcagaggaattgtagagtactgaacaggtaagtcatccctcagccagagattagtctacttcttccatgcgtgatgtgtcgtcatctccttcaaggggtggcatttcttcagttacagcagcactggtatcatcagcagtagggtcatcttcatcaatacccagaccaagtttgatcatcctgtagatcctgttagcatgtgtctggggatcttccagactgaagccagaagacaggagcgcagtttcataaagcaagatgaccagatccttcacagacttgtcgttcttatcagcctctgccttttgccttaaggtctcaataatggaatggtcagggtttatctccaggtgtttctttgctgccatgtaacccattgttgagttgtctcttagggcttgagctttcatgattctctccatgtttgctgtccagccatatgtgcttgtgacaatacagcatggagatgtcaccaatcggtttgacacaaccacctgtaatcaaaaagtgatgactaggaacctagaaagattaattcctaaactttcattgtgaaatgaaatctgtagaacccaaatttcaatagatcccaaatactatctactgtcaaataccacttaaatgtcgcattaggtatcccaagagccccaggttataatttcatgttttacatgcacca

SEQ ID NO: 547 - DNA, 763 bp, Homo sapiens
  misc_feature: Incyte ID No: 099792.1
  unsure 430: a, t, c, g, or other
atttttaacaaaacaaatgtttgtctaacatttgaattctccattcttgcagaaacaattgttttgctttaattttctgaacttggggggggatgtagggttccacttaaagtccacaatgctgtgttttctttatgttggttagataaaggaaactttaaactatagtaaataaccaaaaaaaaaaagagtgaaattcccaaagtcagcttgggcaacatttgctgaactcccaagttgagcacggaagcatgcctagtgacagtgacctacatggtcactgaagatgtgatataatttatgatatatataatatattggatccattagcgagcataatgaagtagtgaaatgaaagggtatttgtgaaatcagttcaaacatcctgctaggattatgattaaatgattaatgaaatgctcctgcatangcattttcaaacagtaattcatgcagaggctgataaaaatcctccaatcatatttccttcagtcgtgaaccttatctcgaccattttatataaatcatgaaatacgttgtctgccggcaagctacttatttagattagttataaatgtgcagaaaaagggaacatctttgcagtataaaataatcacgcataattatattcataattcaagcttgtgacagattccatctttcttattcttgttgtcctttgccttccttctggcttcatttgatttctcttatcttgatgacataattaactgctgaagctatgggaaaaaaaaaaaaaagg

SEQ ID NO: 548 - DNA, 1347 bp, Homo sapiens
  misc_feature: Incyte ID No: 005147.1
  unsure 1172: a, t, c, g, or other
ggtcaaccgtcaaaatgtccaaagaacctctcattctctggctgagtgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccaggctgcacttccaaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctgggagcatctgatacagcagttcctgatcagaacaaaacaacaaaaacaggacagatgggatggaatacccatgtcaatgaagaatgaaatggcccatctcccaacttactgatgatcatcgccccctccttggggattttgtgctctttcgcattggtttgtgggcgtttctcctgagagggaaactcatggagaacctattgttcgcagaaacacacaaggctagactacattggagatagtaaaaatgtcctcaatgacgtgcagcatggaagggaagacgaagacggcctttttaccctctaacaacgccnaggtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtcaaaaa

SEQ ID NO: 549 - DNA, 280 bp, Homo sapiens
  misc_feature: Incyte ID No: 272599.1
gaaaaaaaccccacaaccatgttataggaaaagttagtataaatgacatagcataattaatatattcaaaataacttttaaaaagttgtcttgtagcttgaagggatcctaaatatcaaaagcccatcacaaacttacaagccttactgctacgtaaatatccctttgaactagtttctggttctatttaaaaagtcgaaaacagttgaaattaatttacgaataagaacagatacacactttgtggggaggctgaggtggtaggatctcctgagcccag

SEQ ID NO: 550 - DNA, 1609 bp, Homo sapiens
  misc_feature: Incyte ID No: 238396.1
tgctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgtaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacatggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagtttgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgt

SEQ ID NO: 551 - DNA, 960 bp, Homo sapiens
  misc_feature: Incyte ID No: 023904.1
gggtgtttatgtctgtaacttggcagtagctcatattaggaatcattattatacacgttgcaaatatttttacaattagtttatttattattgcattataaccatgcttacgtagtggtgctctactatttctgccttaggtataatgtttagaattttctctggtcagggttataaaaatactcatgtttctcctgatatttttatgatttcatttttagatcagtctttaatgcagttgacagttacattaaagtagtgaaatagtcaacattttctgtcagtattatctggttgtcataataccatttataaaataattcctgctcttcctcattgatctaaaatgtaacttccactagataatcatatttatgtttgatatttacaaatactattcagttctattttgtctgttcagctactttcactgatttaattattgttgcttcttgtttgactatatatttaaaatatttgttttataactaatacaaggtttcatacctaataggtcaagtattacttcccaacacatacacccttatctctttcataattccatactcttttacagataaactgtagaattatttaatcttccttcaaatacaggttctattggtattctgattataatacaggatacatagatacatacgacattgcatgggtcacataaattgtggcaccttttcaatattaatattcttattcataaagaatattgtttgtcctattaggttcatatgcccctcagtaaagtttttagattatttttctttagtcaggtatcttaatgtgttttaatgttcttgtatttatgaatgtgctccttttttctccccctttacaaaaatgttttctaattgaatattttcattttttaaatctcagaacctcttcacacaaattagtaagggcctcagagaacttttatgttggcaggtatgtctgcta

SEQ ID NO: 552 - DNA, 3025 bp, Homo sapiens
  misc_feature: Incyte ID No: 274712.1
aatctaaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactg

SEQ ID NO: 553 - DNA, 8048 bp, Homo sapiens
  misc_feature: Incyte ID No: 979567.11
  unsure 5120, 8039, 8041: a, t, c, g, or other
ggagtacgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtctgatgaggatctctggcagaattgagtgtgaaagtccaaacagacatcttctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagtgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactctgtggtatccagacttagatttcaggatatgctgaaacaaaccagcattcttaaggaactgactcacctttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattanggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctggggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactcatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgagcatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaaactagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattactcaaaaaaaaaaaanangggcggc

SEQ ID NO: 554 - DNA, 3106 bp, Homo sapiens
  misc_feature: Incyte ID No: 234121.1
  unsure 671, 696: a, t, c, g, or other
ccaaatggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagancaagaaaaacaagagaaagccatgnttgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagtaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcggttttattttttctgtaagctcaatgtgctgaaaccaaaccaggcttttaaaaaccttgtgtagaagaaaaccaaaaaatccttgtgtgggtgtcctttccctgtcaaactcattaaaaattcctttgttgccagtgccaaaaaaaaa

SEQ ID NO: 555 - DNA, 3966 bp, Homo sapiens
  misc_feature: Incyte ID No: 252493.15
ggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaggacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctgcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttg

SEQ ID NO: 556 - DNA, 1264 bp, Homo sapiens
  misc_feature: Incyte ID No: 899766.1
tggaagttggggcgcaggaatgtggctgtccccgcctgtaaatcatggttggggaggagtcgcggaggcaccaggctggggtctgcagcgcgccatctgctgcagccacacaggaggcgctgaggctagttggagacagagtctcactgtgtcactcaggctggagtgaagtggcatgatcttggcttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccggcctttttatagccaacaagagcaaaagcacactgcaatgtccaaacgaattgcaggcgttttctgctccctgaagcctgggaattaatttatatactcagtcccttttcccttggctggccattgaagtagttgaaccacaggattggactgtccagaatcattagccagagttcactgtgagtggacgtcttttagttctgcttcaacgctataaccaacctttaccaaaagcaacaacaaaacaaaaaactgcagaaaccaatgagttctgttcacaaaggatggctcctcatgtcatcacaccggcaaggaatggacgagcctctgatttttctcttcttggctgactttacaaggttggatgcagtccatgaggatcatgcagcaaagacagaaagtgctggagaagcccaacctgcagggcctcacctttagctggtttgtgtggttccacttcatgtagctgttggaacaccagtctctctaatgtgctctatgggatagctgttaccttccactaatttatgtctaatacctataaacctaaagtatctttttaaaaattttattccgtctttttggaggaaatttttgtgcatgccagatatagtgtcaagcattggggattgctaagatgaacgtaacattgtcctcaccacccattaagtcacaatctagtagatgagtaaaagt

SEQ ID NO: 557 - DNA, 6107 bp, Homo sapiens
  misc_feature: Incyte ID No: 247423.13
gccggcggcgacggcggcggccgtcctcatcccggcgcttgagaggacgcggggctgcgcaaatggcttgtccccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttacgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggtttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcattaagtccatcttaatagaatctatgtggtatatgatgtggtcagcccctggtctgtgatcagcaagaacctacagcacagattatgccctgcccacttcaatgaatacctactctcctccattctccatcactttttttgctgtcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaaaaaggg

SEQ ID NO: 558 - DNA, 1813 bp, Homo sapiens
  misc_feature: Incyte ID No: 334234.2
ctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacaggacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaaacaaaaacaag

SEQ ID NO: 559 - DNA, 1956 bp, Homo sapiens
  misc_feature: Incyte ID No: 205672.1
  unsure 1646: a, t, c, g, or other
gcctgttatgtagttcaaaatgaagcaaatcaactgagcaaacacagataggcttaccaggtcataacaactatgtaactgaacagattgaaagttgaataaaataaagataaacttctttagagttttaggcttgaattcttaaaagaaagtggacctcaaaagtgaaaaagatgccttagctttgctcaaaaacaaagataacacaacacagaatcaggcaaccctaagatgccttagctttactcaaaaacaaagataacacagaatcaggcaaccctaatagtagctcctgtttatctaaaaacagagtcagttcactggaccctacatcaggtaacttaatttcatttggtgtcatacatgttggttaaggtccatgcgccttttgctgtgtttacactcagaataattttaggggtttctccttaatgcttgcagtggtgaggatttaggtttcagttatacctacgtagtatttcatacttttcactactcttccatattgcatcctcaaaaactcccttgaagcagataacatacttggtaaaagccaagtatccaaaaagttatggaaccacatcgtgctttcataacattgagtcatttaattgtttcagtagtgctttgaggtattcataaaattgaggggaattaattaccagactaaagatccagagcattttttacagttttaaaggtttttcaaagttattcttagataatatgtttatatatttattatttatttacaagcagtcacttactctgcatctacaataactaagacttgagaatataaaattgagtaagacatcttagtgtgcaaggagatcagagcagaacagatcttacctttggaaaactgttaatttttaccacgttgaaacacaaagattcatagttgatgcgatccagcacctgccagaatcatagcaatcagacttccaaatatgagaatcaaacattagaatcattaaaaatttgagaggcgggggggacagttgtacaactcttgagcaaaagttgacttataagctaatattaatatttcaaatttgtacgacaaacaaatgtgaagatataatgtgtattttatttgaatgtcttccctatcacaaaatcacatgagtaagttgagttggtaaacatttatttatttttatcttttctaaaatgctgaaaagaatttttctcccacactaaagagggtttgccaagtttctgcctggagcaatttgttatggctgtgtaataaatcccagaaagtttgaatttttaatggaaacactgacagaataaagagggtgtaatcctacatatgtcatttaaaaatctgagcaaaccatagtgtgcttgcaaaacaaatatactttccttagattgcactcacaaataaggctggggagaccacaaaagtaaaacaaactcaaaagtgaaaaacactcacacaatagactctgaggtcagctcaccacacccagactaaagtcactgggctctgtgcgtgtcaccaagactcttaaaagacatacttctgaatcatctttcttgaccctccaccaaactgtagcaagacaggcttcctgggaatgaaaatgacattagcattagtcaagagtgaaattaaagtcattgtactcaancatctgccaacagtctgtgatttcatagtacccacctctgaaataagactctgtctacaattaaaaacaaagaaaaaaaggtactttaggtcttcactatccactatgtctactgagcacttgaaatgtgtgattagtccaaattaacatgtgctgtaagtgtgaaatattcctcagattttaaaaacttggtataaaaaatacatattttacatataatatatattattcattattcctatattattaattttatgtattatatatacacacatgtaatatctccatttttacattgattaaatgttga

SEQ ID NO: 560 - DNA, 8411 bp, Homo sapiens
  misc_feature: Incyte ID No: 1327024.5
  unsure 8361, 8372, 8381, 8388, 8398, 8405-8406: a, t, c, g, or other
gcgggaggagaggtttgggaggcgcaggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaatttttttacaatgggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcaccaacactttggaacctaatactgtgtaaggctttacaatatacggattggctttttgtgacccagattgattggttgccacatgttatgtttgttgaagtggttctcacgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatggagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatttaaaaaaaanaagaaaagaanaaaaaaaanaaaaaanaaaaaagaanaaaaaannaaaga

SEQ ID NO: 561 - DNA, 2179 bp, Homo sapiens
  misc_feature: Incyte ID No: 2925789CB1
gtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataaaaaaaaaaaaaa

SEQ ID NO: 562 - protein, 413 aa, Homo sapiens
  misc_feature: Incyte ID No: 2925789CD1
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 563 - DNA, 2240 bp, Homo sapiens
  misc_feature: Incyte ID No: 335613.1
aataaaaatgagcattgtttttgagaagatatttagaagccattttcttacaaaggcaattaaactaaaaactgtgaaaaacccagggcaatgttcctcaaaatttgcagttgatgtgtttgaaatctgaaatttcacaatttttatttttcaaggctatactatttaaattattgatggcaaaacagaatcaattttaagcaaatatagtaatttagaaagtaaattgaaaaaaagaaggtgaaagttattttctcaatcatgcaactgagagacacgcaatattggcagaatctgacctgttacacagaatgaaataatatcttgctgacataatcacaagggcttattgttttcgcataactatgtttacaataatgttgatgccaaactatgctgtttaaaaaacaacaacaaaaaaaaaacaacaacaaaaggattttgaactgctgtaaagcgagtatacagcagatggcggtgttacttctcttacagttctgctttgatatttactctgtaccattcttcctcctagtggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtgtttttttttactaaacagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaata

SEQ ID NO: 564 - DNA, 711 bp, Homo sapiens
  misc_feature: Incyte ID No: 207646.1
cttctgcaattaactacttttttcttaatttctctaactttggcccaactaaatattttcccatcattcctgttttgccgccctcgagctaggacatggaacttacttgttcggaaaagcttctatctgattgaaagggcatgctaattctttctttatagtgtaattgtttcacatttaagagggaaggagaaacgcctaaagtaataccacagaagaaataccctcaactaatctttctaagcagtacgacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaatcagtcacattttaacttactgccagcacggtccatgcttataattgccaaatattttatattaaagaaaacaaggtgtgggtttttttttgtttgaaaccttgtaaaattgtggcttacgtaaaaatgaaataagtatagaacatggctttttaaaaatatcagtggcaatgataatgacactttatattgtatgcttttggtcgcattaaataaa

SEQ ID NO: 565 - DNA, 990 bp, Homo sapiens
  misc_feature: Incyte ID No: 1720847CB1
acagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgttccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtgaaaaaaaaaaa

SEQ ID NO: 566 - protein, 90 aa, Homo sapiens [sequence omitted]

SEQ ID NO: 567 - DNA, 864 bp, Homo sapiens
  misc_feature: Incyte ID No: 2313349CB1
aaaaaaaaaaagcgtccggccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaacttaatttctcatacatttatagaagttgggaaaacaaaaggggggggccccctaaggggccccagctttgagggccggtttttatggggggtcaaacccccttcaaaggggggcccccaaaatttattttcccgtggggcgcttttttttaaaacacgcgggggaaccctgggaaaaaccccccgggggtttttccacccaatttgttaataccgcccccttgggaggaggaagaaaccacccgcccttttgtgtcccccacagtggtgggggggagagataaatgggcgaggagagagggcacccacacaacagatgatgttcggccctcttctctacacacaggatgtgtgtgtccgccgtccccccgtcaaagagggcgcgcgaaactagtggcgcgccgccc

SEQ ID NO: 568 - protein, 68 aa, Homo sapiens
  misc_feature: Incyte ID No: 2313349CD1
MPKHEFSVDMTCGGCAEAVSRVLNKLGGVKYDIDLPNKKVCIESEHSMDTLLATLKKTGKTVSYLGLE

SEQ ID NO: 569 - DNA, 3900 bp, Homo sapiens
  misc_feature: Incyte ID No: 107939.2
  unsure 3896-3897: a, t, c, g, or other
atcttcatttcatagggagaggaagacagtgttcgggtactgcctaaagtagctatactagtagttcagcatgtactaattggggaggcaattccagctcatccagttcccttcccatgcttcctcctcctcctcacaaccaagtgtggcctggctgacacatccctatggctttgtttcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatgtctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctatannata

SEQ ID NO: 570 - DNA, 210 bp, Homo sapiens
  misc_feature: Incyte ID No: 011540.1
tgaattggtgaaaacccacagaatgcacaacatgaaaagtaagcagcaaatgatggagggacattaatatcaatgtatccaatattggcatatcaaatcttaacaaacaaacaggccacaataatacaaaacgttactaacagaggaaactggcaggaagtcaggaggagaagggcatgtatgagaactctgtactttctgccccatttt

SEQ ID NO: 571 - DNA, 601 bp, Homo sapiens
  misc_feature: Incyte ID No: 078831.1
  unsure 7, 14, 60, 208-209: a, t, c, g, or other
ctgctcntcactgntgaatgtggaagcatttatcaaggaagactaaaagcaggaagaatnaatttcactagcagcctgtgtgtaggcagctgttgttcattagctaataaagtgatgactgcaagtcctaacgaattctttctagacatggtttaataattgtgaccctttgtcatggcaaagttaaagagactaaaatgataatggnngctctatcacaggttataaataagtcttatgcttgaaatttctgagtttaacagaacccatttttaaccagttctgctgtaaatctatttcagaagtaaaaatctcctttgattaaatcagcattaaatgttcaggctgtaacagtttcactaaatacagaaacactaattagctgttagggccatattttttgcataataaaatgctgatggctttaccaagttggagacacaccagatccaattagagtttattgactggggaagtggatcttataattggtaatcttaaagaatgagcttcttgaatatctgtaagccagtttcaaaaactttaactgccagcgagaattgacaagattttcttgattatgtttctatgcctttgattt

SEQ ID NO: 572 - DNA, 1192 bp, Homo sapiens
  misc_feature: Incyte ID No: 207778.1
  unsure 1058-1085: a, t, c, g, or other
gaaagttggagatgaggttttatgtctatgaatggccatgcaggacaaggacacagattccattaaccccacatgaaaacacagcctgtgttgaaactgcatgtggaaagaagtcctgatttatcttcacctggtcctctttaaatgatagattttttttttcttttacctccttttttgttttgattagtccattcttaatctaagccagatagactcttggtcttatccagttcttcctttcttctgtaaaagtattttgcaaggactctgggttctgtggaactttgggcaggaggctcgagaaggcagggctcagatgagccacccaagttcagaggctccttccttcttcacgctcatctcagccttggggaagatgcatttgcttggtcaatcgcttgctatgtcacagcatcctccaggtgtctggtgctggtggtggagggacgtagtagaatgaatctccctcctcacacccatcagaaagtcttcctgcaccccaacattacctccttcgtcagctcccatgcccacacagtgctttttaaaccctccaaactggcactcagagctgccccctgactgatggcagctgccctcccctggatggcctctggaacacatttgtgcgtcctgcctctgcctcttggctggggccattcctcccattgaaataaccccttctcagtgtccagctccagggccccctccccttggaaggtttctctgaccattctagctaaaagtgcttgctcctggcctgcgttcagcactttctgccgagggtgaccacgtaatctattattcataacacttttgagatgaaagggaatcttactaatatgctgggacatcagggataaaccaggactgttttggggaaaccattctcaggtgtctacttcttctatcccgattgactttagctcctcaagggcagaaactatatcatatactccatagtatttgttctaactccagcacagggccttgtacacagaaggcactgattaatgaaataaacaagaaagaggataagttgatgggagaagtgnnnnnnnnnnnnnnnnnnnnnnnnnnnnctgactgactgacgagtttctaacatgcttaaccttttctcagagaataagctagttacctgagtgatgacttactacttatttaaaagctcccatatttatcagtt

SEQ ID NO: 573 - DNA, 3940 bp, Homo sapiens
  misc_feature: Incyte ID No: 296811.10
tttcagccattgcgtgcctcccggggggggcagccttgctccaggctttttgcatagacgcccgggcaactgaatacaaaaagggcaggcctcctgcgccctccttcccaccccccttcctgccctgggcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaaccccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaactacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctc

SEQ ID NO: 574 - DNA, 201 bp, Homo sapiens
  misc_feature: Incyte ID No: 333776.1
  unsure 159, 175: a, t, c, g, or other
cgtgtgtgtgtgtatacacacacatatatggaatgtgtatgtctaaaacaaaacaacctagggcttgaagaaggtagctttcagtaaatgatggccgcatggtatatttattttttttttaagtggttgaatttcattgtattgcagagcaagggaganttgctccttacctttntctctccttgcctttttttcatcttt

SEQ ID NO: 575 - DNA, 2543 bp, Homo sapiens
  misc_feature: Incyte ID No: 1859458CB1
ccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctggggacctcagggtattgcttgccactaagccatgaaaccagagaccaaattctctatactgggcatgagatggggggggaattctcaggtgcccaactgtgggctggggtccccattccaaaggggactgtgcaagtttggttgtccaaccatgaaacacccaagatggtctggtccccggaaagcggtgattttgacaaattccgccatgcctgt

SEQ ID NO: 576 - protein, 591 aa, Homo sapiens
  misc_feature: Incyte ID No: 1859458CD1
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 577 - DNA, 1559 bp, Homo sapiens
  misc_feature: Incyte ID No: 110960CB1
cccaggcccggccctctcctccccccgcgccgatggtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccagggaagcccggcagagccctgagccccactgcaattctcctagggctgcacatcatgtggcttagggacactgtctgcatccagtctgtgtctcctgtcttc

SEQ ID NO: 578 - protein, 316 aa, Homo sapiens
  misc_feature: Incyte ID No: 110960CD1
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 579 - DNA, 1488 bp, Homo sapiens
  misc_feature: Incyte ID No: 238602.2
cgtgagcgggcggccggccggacagactgacgtgtgagctgcatcgcgggaggcgcatggcggggatggcgctggcgcggggcctggaagcagatgtcctggttctactaccagtacctggctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctggg

SEQ ID NO: 580 - DNA, 960 bp, Homo sapiens
  misc_feature: Incyte ID No: 363007.1
ggggatcaccaaaaacagaaacaagtatcagaaacatacaatgctaaaaacaagaaaggtaagccccagacaatccattaataccgggagagctgaggctggtggcagggcagctaggagggccaaacaaagaggtacttgggaacaaaaggagaatgtacacaaggcaaacaggaattgagacccacatcatcagccacaaagatcacgcctcaagattgaagttagcctgttgtgtcttatccttagtgacatttatacttcttttatcttccgtagttctcatccatacttctctgacactgggaaagctattctagaataaattaagtagctattatgtgattatgtgtcaggcatttgctagaaattagagtacaactctagagagcattaggaattccccccaggaagcctacagtctatgtaggaagtaggcatggattacctcaatacaatagaataaagactacactaaattttacagctgctcagcaaagaaggggcactttgccaaagatgaggtctcacagaaagacgtttcatcacagtttctataaatgcctattgattttgcctatgtcaacaagataactaaatccccagacagtctatatgttttctggagatgtgtcagtatatgtggcatgtgaacagtcatataaaacttggatatgtactcattttgttacattgcttttttttagctaaaaggctgaatatttgccaaggtcatagtagaattcttcactttgtttgacaggctgaagactaaatttttgaatgtcaaacatagtctgagttttttatctaacatcatttcacttatattttctgaggaaatttgttttttccagcaagaaatctctatttgaaacaaagtcatctgctgattctgctacaccagcagttaggctcttctatttctttcctctcaatttctacatcagtctgaagggc

SEQ ID NO: 581 - DNA, 1278 bp, Homo sapiens
  misc_feature: Incyte ID No: 3478236CB1
aagagcttatgacgttcgcatgcaacgcgtacgtaagcctcggaattccggcttggaggccacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaactttttt

SEQ ID NO: 582 - protein, 252 aa, Homo sapiens
  misc_feature: Incyte ID No: 3478236CD1
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 583 - DNA, 1475 bp, Homo sapiens
  misc_feature: Incyte ID No: 2466714CB1
ggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactataatagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataataaaaaaaaaaaa

SEQ ID NO: 584 - protein, 456 aa, Homo sapiens
  misc_feature: Incyte ID No: 2466714CD1
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYNRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 585 - DNA, 570 bp, Homo sapiens
  misc_feature: Incyte ID No: 004208.1
  unsure 538, 549-550, 560, 567: a, t, c, g, or other
aaacaatgtcatgagagttattaatttttggagttaagattattgcctcctaactgactttctgaactttttggatttagaaactactgctttgaaggcaaatatttgctttccatattaaaaaaaccactttttagaatatgtaaaatgacacactaacatgaactaaattcataatgaagccaaattctttttaaaaatattaaatctataaaattagaaaaccatttcacccttttgtgtaaaatacctatgctaatgccttgctcactcgttttttaaaaaatcaattttaaggagaataaagaattctgctgcaaaaacaagttgaaagtctaaaactcgtttattgcggtagaggctccaagatcacacacgtccattagaggtattcagtgcagggtcactggagggtcggcaagagacagccaattagatgtctgtttttcctttcaaagtcctgtctgtttccttcactctcttcaaaacaccctaagtagacatatatatcatgaagtcaaagcgaaaaaaaaaaganaaagaaaagannaaaaaaaganaaaaganaaa

SEQ ID NO: 586 - DNA, 2029 bp, Homo sapiens
  misc_feature: Incyte ID No: 903475.2
cacgacggccagccctggcccggctgcggtctcagcccgggggccctggatcgcgcagaaacgcactgaatgggcccctgccatcgggctccagaaactacctgggctcggccgacctgttgcctcatattggccaaagagggggaaaccagaaggagggaattctgctgcggcgacttgactttccaggcccggagcagaaaggcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctaggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgcctcatgccagaagcggctggacagtggctgcctcatgacccttgcagtctcccacatccagggcctgatgacatgcccccttgtcccaagtttcttgggaacccctgaccctgctggcccctctcatccaccccaaccctatccaccctggaccacctctgggggtctgtcagcctgctggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctct

SEQ ID NO: 587 - DNA, 1437 bp, Homo sapiens
  misc_feature: Incyte ID No: 246037.28
agggagccgcggaggtgcaggtcgaagaggccgggctacgtcgtgccctgcgcgtgagcagctggcagcgggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctctttttattgcctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcag

SEQ ID NO: 588 - DNA, 1291 bp, Homo sapiens
  misc_feature: Incyte ID No: 337183.1
  unsure 1286: a, t, c, g, or other
aaaaaaaataaaaaaaaaagaagccacattaacaaaaactccttgtgattctccatagttttaagactataaaggggagctgagaccaaaaagtttgagaactttttcactgtgggatacaaagttgaagacaattatagttaaataagcaggagatacagagtattttaatgaacagtagatggttataagagtcaagagatgtacagagaaaatgctagtgattagagtttttagattattttaattttggtaactaattataattcctcagttaagattttttggcttagtgggcccttagaattacttcttcctgttagaattaaaagtgaaaccagaaattaaagtgatttaatttttttattgtggcaaagatctagtccaaatatctttgatggactttttgaaaacagactttattgttaaaaagggaatttgaggcttggtactgaacttcttctgcatgccatattgaagttggtggttttttgtttgtttgccatcagtgggatctcatacagactatggaatttaatagaatttttaagatactgtttttcctaaaaggtagctaactaaaggcaggaaaatagaatgatgtaacaatataatgactacatctggagtttctgctactaataaataattgtattgtcaactttagtcaaatattctgtgcattcagtcagagctatctgaaaatactgacgaatagtattacaatatggggaggtcacttctcaagactgcaagaaaaaaaattgttgtgtgtaggaatgtttgcctaggaattaggaatgtatacttgacaacaagtgaacgtatccattgaatgttaaatgagaacaacttatggggaggatagtgagaggtatagtatttaacatggaaaagttagtaatatagtagaatatttggttgaaaagatccacattggtgtattcaaagacacactgaagactattgtgcattagtaagtattaaacatgagaattcttaattttaaaattggaccctaatttctgagatttactttaagaataaaaggggatgaaacgagattggccatgagttgatcattgttaaagttgggtgatggctacttagagttgcattattttagtcacttttacttttgtatatgttggaaatcttccaaaacaaaatgtatagccataaaaaaaagggagcaaagtaagaaaaaaaggagagcctaaaaaaaaaaggtacaggcaaaaaggtgtgaaaagaaactcatcaagagcaagagtattaaatgaganacata

SEQ ID NO: 589 - DNA, 4170 bp, Homo sapiens
  misc_feature: Incyte ID No: 2651836CB1
  unsure 4124, 4127, 4131-4133, 4135-4136, 4140, 4150, 4153, 4157, 4161: a, t, c, g, or other
ggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggnaanaaannnanncgancccagcgccngcngacngaantgggccgcc

SEQ ID NO: 590 - protein, 1034 aa, Homo sapiens
  misc_feature: Incyte ID No: 2651836CD1
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 591 - DNA, 677 bp, Homo sapiens
  misc_feature: Incyte ID No: 080339.1
agcttttattcatagcaacccaagatgcatttactctcaatctagcttcagcagtaaacgcttccctgatgtattgctttggacttacaaagaaatatttgtgctctacataatagtatagttaggagaattactgcatggttgagaagattctataaagctttatagctggtggtgttactgtaatttaatcacaatgtagctaatgtagtactttaatatcacaggttacttttttatttaccatttattagtaactgacagagtcaatcatctctacatcataaacaaatcatggagggattctataggaaccctaaaattccgggatagatgtactatggctgttttacactaccacattccctgtaatgagctaaccatcaaattattatttagatctgtgaaatgtaaggcaggctccttgttcttagtccattggccaaagaaaacttgaggacattttatgtcaggaatacaattagcaccgcatgtcatttatgctcagaaataactcattgatccaattctagcaaaatctagaagcattttctgaaaaatgttaaggtatttagctaaaattttttctaactgttctgtaatctattcatgaacattaccataatgttaagcttaaaccaatgctttgtcattaggatttttaaatgaaaagtatg

SEQ ID NO: 592 - DNA, 4557 bp, Homo sapiens
  misc_feature: Incyte ID No: 480968.13
  unsure 1776-2083, 2164-2465: a, t, c, g, or other
ggaaggggaagagtgaatgagtaggggatagttggcgggtggttgagtggaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgtgtgtggtgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacaggtcccagagtccgatgggtggtccttttattcctgctgctcctgtcaaaactgccttgcctgctggcccccagccccagtcccgccacccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctattaattttctaacctgatgttcattcaggtgtttaatccaacctctataatctgttggccagtgaaaatacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttcttttttttactttcatagtgttactttagcctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacacgttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagacccgtccttttccagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactgggttgcagctaaaacagagagatctgactgctggctataggattttgggattaaatgactgaaaattgcaaaattggcctcttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattcaaaaaaaaaa

SEQ ID NO: 593 - DNA, 957 bp, Homo sapiens
  misc_feature: Incyte ID No: 337448.1
gttttgaaggaggagcaggaggcactgtgcttggatctgtggggcacagagaggcgagaggagaggagggagcctgagccccacagcaggcaaggacaagctctgggggtcaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccagggggaactccaagagactcccactgtggactccaaagatcatgatagcagctctggactatgatcctggggatgggcaaatggggggccaggggaagggtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgg

SEQ ID NO: 594 - DNA, 785 bp, Homo sapiens
  misc_feature: Incyte ID No: 005360.1
tgcataccccagtcctgtagaaataactgttctcgggctttaggttttccagatttccctcagagctctagaaactgagcgatggacagttgctctgcttcttcaggttggaactcttgatacatccttgtttcctgaaattccaaacttaacacctatagttctctcaggctttttttgaaaagttccttcgtttctatttctattccactctatttagctattattgtgcggcacccccaatggttcctttcctctcagcatcgctgtagcttgcctgtacccaggacatgcccttgactggcacaaaccgtgacagacatgcccttgactggcacaaaccatgacagacaaggccacctcctcagaagcggaacaacctattatcttttggcaatgggagctaacttcactgttttcttacaatacctggtttttcctatctttggtttccttttgattatctctcatccatctcagccactattctcctcccctcccttgtgtctacaacaccccattttaccaagtctcccatttaacctccccatccttttctttcccttaaagtctcatatgatactgcagtcctcatttgtcttcccaaaaaaaaaaaagaatttttttttttttaaggaatccttccttgactcctaaagactcctaaggatgctgaggcctcctcagcatgatttccatatacttactttctctgttggactgcagacaacttgaaagcaggaactttggcagtgtttccccagcaccagcatcatgcctggtcc

SEQ ID NO: 595 - DNA, 488 bp, Homo sapiens
  misc_feature: Incyte ID No: 998599.8
  unsure 470: a, t, c, g, or other
attttattagcattttttagcaataaagttttttaattaaggtatatacattgttatttagacataaagcttttgcacacttattagattacagtataaataaaacttttgtatgcactggaaaaccaaaaaatttgtgtgactagctttattgtgacatttactttcttgtggtggtctagaatcaaacccacaatatctttgagcaatggcagtattgcttttattatgcttaattaactaaaagcaggtgggaaaaatgccttcagtgggtaagtaaattctcttttcaaggatttcagaaacaaattttgaagttttggtttagtaaattagttttattaactttatttattttaatgtttttaaattgcagatttgctgttgctgagtctgattgtaatttagcagttgccttgaatagaagttatacaaaggcttattccagacgaggtgctgctcgatttgcnttgcaaaaattagaagag

SEQ ID NO: 596 - DNA, 1112 bp, Homo sapiens
  misc_feature: Incyte ID No: 332821.13
gcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtg

SEQ ID NO: 597 - DNA, 395 bp, Homo sapiens
  misc_feature: Incyte ID No: 344186.9
  unsure 134, 237, 245, 346, 374, 388: a, t, c, g, or other
gtagttttaagagacagcaaatttagttatattctctagtgatctatataagtcaacaacttgatttgaggagcacatttacaaactgatgaaaagtgattcatacccacgttttataagatccagtgcctatnaggagcttctacaggcaaagaaaaaggggaaatctctcacgtccaagaggttaacaagccttgctcagtcttactaaacggatcatcttgtagcatgaatgcngactggantcactgcacacactttgtagctcaatgttgtgacctggagcagaggacattagaacaagatgttgcatgagcaaaggacctaaattgttatttttgtgtgnacattccatctccaatggactcttccgnctcaatgcctccantccaaac

SEQ ID NO: 598 - DNA, 1651 bp, Homo sapiens
  misc_feature: Incyte ID No: 344186.12
caagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaagcactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatat

SEQ ID NO: 599 - DNA, 1516 bp, Homo sapiens
  misc_feature: Incyte ID No: 212489.1
cacagccacccctgctggtgcctccctggagtggtcccaggcccggggcctgcttcttctccccggctccccagcctcggcggctcctgcccgggccccaggaaaactcagtgcagtccagttatgtcctgtcctccttcctgtcaggcagctgctgcaggaggggtgggcaaaggcatcttcctctgggaaggactggcacaagcacttggtccctgggttgtgtgcctgggaggccgggatcagggctggccctctttctccctggcaaagcaaaacctcccttttactactatcaaggggaagtaacttgaaggtaggaacccagcttgtgagccccctagcctctgggctgctctgcatgtgccccctcttgctggatcatctggtagcagccctgtgccctgagggtgatgctctgacctatgcagcccccctccctgtcctgagaaggcttccagctgggccttggaggacagggtccacccctacctcctggtctccttcctcagcttggaagccccggagcctgccctgctgggaatcggggaagcactgcttacctgtctcctgctcccttttcaggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggacactccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctgaaaaacaaat

SEQ ID NO: 600 - DNA, 363 bp, Homo sapiens
  misc_feature: Incyte ID No: 080711.1
  unsure 7, 20, 27: a, t, c, g, or other
cccacgngtccgcccacgcntccgctngtagctcagttctaatctcaatgaatgcaagagtcactgacaacctgctatagccaaggtactatattaggcactgacaggtctagggtgaaaaagagacatcgcctggttttcacagagcatacttactagtgagaaaagataaaaatcaaatatttaaagaatatgattttgagggataatcacataacctatagtgagtgaatctggatttaagggcttctcaattcaaagaaaagggaaggccactatgaagcagtgatagctgagctgatacatgagataatagacagacctatacatgtgatgatctggataacagaattctatataggg

SEQ ID NO: 601 - DNA, 521 bp, Homo sapiens
  misc_feature: Incyte ID No: 080787.1
accaattctggctaacttaggcaaaaagcaatttgtttactcatagaataaaaagaaaatatggttacctagggtaggtcagggaattactgaactatcggtagggcattctcatcggttaacccaactccagttgctttctgtcctgaggttcaaattagccttaaccaagtcacatcctcacctaccctatggtgacaatgaggccgggggtttgtggcaggagatggtcctagtcctgtaatgagtagccccaccagccactcatggcatggagacacagcaggtctcccaagaaggttgtgaggcccagaaagcaaaacagaacaacccagattacccactaacacatgatttgacctttttattaatggctttttttttaaagcagattatagtggtgtttaaaatatatgtgccatataatgcttagaagataattttcttgatacaagttttgtttatttcctaaagagaactgttgaaatgtgcagagtatctggaaaaaataacatctatat

SEQ ID NO: 602 - DNA, 1553 bp, Homo sapiens
  misc_feature: Incyte ID No: 334352.1
aggcttctgacgatcaaattgtaaaaaaaggggtcaggtgttatctccagactgtggaattagattgtagtagaatatattttacctacaaacattttgacctcacccaagagtaaggctctcttttttttcttttttaatgaaaaaagaaaggagaatatttgctatcttatcttaaaaaaatagatccttaggtgattacaattttaaaataagaattgagagcccttactatgcacagtcctttaagttcataaagcttgatcccaactctgggagatggggcaggacaggtgttaatgtccctgcctttagcagatgaagaaaccaggctctgagaggagaagctacttgcccaaggcctgaaggcctctgaaagaggagcagagctcagggcacctggccctccttggtcccctctctactccacggtgctgctactcagggtcatctcaaaactatgtaaaggcagatgttgccaatccacaggcttcagggactcttatcaagactcatcccaacttttaaggcacactttcacaccgctcacattgtgcattacattttggagtccttgttggaagtgaactttccgcctgtaagcctgccattccatgtctaatatattgggatggcatcaccttctgtactatgcagcagaaggagactggcctgggattctggaaacatgagatccatttgcatattaatccccggctcgctgtgtgaccctgagcaagtctccttcactttctgtgcctcagtgtccttatttgagtaaaaagggaataaaactagatgagtggttttcaaactttaaaacactggaagctctctttgaaaacaaaagatgagaattgaaatggatggcactggaagctgttcttgtctactggggtttggagctgccaggggacctgctcacatccactcctcactcagcccctcccgcccctcccttctccacgcactgtgactgacttccatgtgtgaaggcctgcagttaattctcctgtgtcttgaatggttgggagatgagttggtcagacccttagtgaaatgatgtgggaaggaacaggaatgctgtggctctgaagaaggtagtagaacatcccacacctgctaataagcacattttgcaaactcagttgactcacctcagatttgcctagtgaaaactgaagggctggatgtagacccagagagcagggtggacagagcccatgctggaagtactgagcatcaggactgtatggggctggctttagcatcatcattctgtgcaaagacaaataattaatgtcacactgtctgaaattttcaccaaaaccaaaaaggcgcattaacatgattgttccaacctcatggtttttcaagtgtgagcgcccagagacctcttcagaggctaagagagcatgcgctgccacagctgttagcatttggagacgtaattacaatgcccccactccccgcaccaaacctgggtttttctaccgtttttgtagatgtcatgatgtcacgacccctgcaccctgaaaaaaataaatgttttt

SEQ ID NO: 603 - DNA, 563 bp, Homo sapiens
  misc_feature: Incyte ID No: 208376.1
  unsure 560: a, t, c, g, or other
ggtaaagattctcttatttgataatcctctagaacatatgtaaatatgtgttaattcatgagtctcagccagatttctttagggattttgatttgacagtttctcctttcttatataattctactggatgaattattttatgtgctttaaaaaaagcattttgttagttaagctgttacccttgtgcactgtgcagctcatggtgttatgggaacttagtgatcttggccagataccgagttaggggtaatcagaaattagaaatgactggactgttaatatttacattgtgctcagctggtttataaaagtacactaacttcctcctatgtccaccccaatctcttacatcaaaatttccagggtcagggcttgggaacttgtattttaaaaaatgatccccaggactttctgggtgttgggaatgttctcatattttaatctatggttgttacatagtgtgtatgtgttaaaatccctcaggatgtacatttaagttctatacacatcattctaatattgcattctctcaaatgttacacccgaattttaaaagtccncca

SEQ ID NO: 604 - DNA, 236 bp, Homo sapiens
  misc_feature: Incyte ID No: 007820.1
cggaattcggctcgagttggaatctcccctaataccaaaacaatcttgaaaaaaagttcaaagactcacgcttcctgatttcaaactggctataaaactaccatcatcgaaaccacatggtactgtgtagggacagacatacagaacacagatcctagaaagaaaatgcttgcatatgtggtcaaatgattttttgacaacagtgccatgatcattcaatggagaaaggatggtct

SEQ ID NO: 605 - DNA, 96 bp, Homo sapiens
  misc_feature: Incyte ID No: 081447.1
cctggattagatccttttgctattaaggacagcaccaagatagcaaaacttgatgttgtcgctggacaaacaggaaatgggagttccctgaactat

SEQ ID NO: 606 - DNA, 311 bp, Homo sapiens
  misc_feature: Incyte ID No: 081821.1
  unsure 153-155, 162, 166, 169, 271, 275, 278, 290, 294: a, t, c, g, or other
gcaaagcattgtgggtattactctccagaagaaaccaatttctcattcagggacccatgctctaatggccagatcccaccatctaaccctatggcaaatggggctgcaattcttagaaatatgctgcattcataaacaaaaacaaacgagagnnngagaganaganagngaaatgagaaaacaggaaggcactgcctgtacatgagaaaggcattatgaataaataggaaggcatttctggaaactcaagatattgtcagaaaatttcagngganganttataaagtcangggnatctcctagactatgga

SEQ ID NO: 607 - DNA, 789 bp, Homo sapiens
  misc_feature: Incyte ID No: 081869.1
ccgcgcccggccgtcatgataatttttaaagtgattatccaattaggaaggttgcagaaagatgcccacttagtgataggtagtttgagaattgcagatccaaaaccttaacacaatatgattagctacacattccaatcactttgtggtgcctgtgccactcataatgttctctttaactgctcctcagggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatcccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactc

SEQ ID NO: 608 - DNA, 1371 bp, Homo sapiens
  misc_feature: Incyte ID No: 210011.1
agtcgaggctccaaatgccatcgccctcggattgtgcctctgcagcttctctgaacgctactacggcggggccgggggcagcccgggcaagaagcccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgaggaccgccagcagccctgagcccgagcagggttccagggactcgctggagccgagctccatggaggcctccccggaaatgcatcctgccgcccgcctcagcccccagcaggcctttccgcggactggtggctcggggctgagccgcaaggacagcctcaccaaggggcagctctacggaaccttgctcaactgagcgcctgcgttgcaggcctggccgtggtttcgctccccgccagccccacgtgccccagaagggccggcctcaccctctccccagcccccgctgttcccctgccccggccaacaacgaggagtctgttcctccccgcacctcctctcccctccccagccctgtaggcctgaggggagggtcccccacaccacggtgtccacccggccccgccccgtggaactccacttagagcgttttttcacgcgtccttcccccatgtgagaggtagcatccccccttttatatagcgaaactatttttatagagaaaaagggtctttcttaacgcacttggtctccagctccctggacggcttgccttgggcgttttttcaaacacaaagctcctttagttttttgggcgagggtgcgtggtggcctgccccttggaagggaagggaaggtacggtgtcctgtggagtacctagtactctgccaagtggggtagaccacccccgcaagccagtgacaagggtagtccctgtaagttgtgtcccacgaaggagggagctgaaaacaaattcggggcctatgaagtgttttaaaaatcccattcctccgcagtgtggcccaccacaccgccctgaagccctcccacgtgccatcgtcaccgggtgggccgggatgatgccccagtgcggaccggtgcctcatcctccgcccccgggtccgcacacactgacaccgtccttactcctacctcagacatgaaggaggcccctcccattccctggtttctgtagcttgcattcttgttgtctctgcatgcatgccctgcccagttagtactgtattttgcattcattaataaaagacaccggtggaaagaaaaa

SEQ ID NO: 609 - DNA, 707 bp, Homo sapiens
  misc_feature: Incyte ID No: 480336.3
attatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgaaaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatccccccaaattcatatattgaagccataaaccccaatatgactctattcctagaca

SEQ ID NO: 610 - DNA, 1532 bp, Homo sapiens
  misc_feature: Incyte ID No: 1024610.45
acgattcttagatgacattttctctttccccttttttccccctaacctcaatctaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaagcaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttatagtcaattgttctctactggttatgctccagcttcgtgagccactgtgcccagctgagatggttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagt

SEQ ID NO: 611 - DNA, 701 bp, Homo sapiens
  misc_feature: Incyte ID No: 082013.1
  unsure 675: a, t, c, g, or other
agaatttctgaacttgaggacagggttttttaaaagaatccaggaagaaaaagtaaaaaataataatttttaaaactgaaaaaagcttagatgacatatgggacatcataaagcaaccaaatattcaaattttgggtattctaggagaagagatgggcaaaggcataaaaacctatttaacaaaataactgaaaactttccaagtcttgtaagcaatatagacatcctgatacagaaggctcaatgatgcccaaatagattcaatccaaaaaggttttccaaggcccattacagtcaaactgtcaaaagtcaaagacagagaattctaaaaaaagcaagagaaaggcatcaagtcacatataagggaaccctcaggcgtcaagtcacatacaagggaaccctcatcagaactagtagcagataccttggcagaaaccttccatgccaggaaagaatgggatgatatattcaaagtgctaaaaaaacactgtcagccaagaatactgtacctagcaaagccatccttcaaaaatgaaggagaaagtttttcccagagaaaatgtatcacaactagggtggcccgatcaaaaatggcaaagggtgtcctacatctggaagtaaaagacatatctaccatcattaaacaaatgaaaataagaagctcactggtagagnagatacacaaatggaaagagaaagga

SEQ ID NO: 612 - DNA, 739 bp, Homo sapiens
  misc_feature: Incyte ID No: 212155.1
cgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttccgaagtcattaaactggttagaacgtgtctgcaaaaaa

SEQ ID NO: 613 - DNA, 836 bp, Homo sapiens
  misc_feature: Incyte ID No: 022632.1
ctcaaagacatccattccaagacacatcaaactgttgaaagccaaggcagagagattcctgaaagcagcaagagagaagaaaccaactcatcacattcaagggatgctcaataagatgatcagtcagatttctcataaaaaaactttgggccacacagcattggtggagacatggctggtttggagcaggagcagcttggcaggctggcttgacagggcggctggagctgagggagctgcggccagctgcgggcctctgggatggagagcaatcaacatcatcatcctttggagaatttagcgacggccgccctgtgaacccagatccaagaaacaatttctgataaattgtgtggtgatttttctcaaaaacatacctgttcttactggtaccatgtgcaaaaaaagcttttcccatgaccatgaattgtttactataaacgtggtggggaacttgggaccctgcttgaaatatggaaacccagttccaagaatgctctttacaaaatgacctggtgaacagaacgtgttccaacgaatatttggtcaatgggtacttttattgggaggtgcaacttgacactcataggcttcacaaagaaggaaaattgctcccactagttcatcaggtgttatttaacaacaaagtaagaggaacgaatttcagtgatgtttatactaataagtcttgctagtacagtgtcagttatttacacgtggtaatgcccgataatgtcttttacctgtctgaggatgttttaaatacatgcattgtcttcacgaagaagatgtaaaaataatgaaccaataaattgcggtggaaacctcaaaaaaaa

SEQ ID NO: 614 - DNA, 3816 bp, Homo sapiens
  misc_feature: Incyte ID No: 2789525CB1
cgacgcgcgcagcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgatttttttttttgttttgattttttttaaactaaagctatataaagcttgtggattaaacagaataaatttctaaatttaaaaaaaaaaaaaa

SEQ ID NO: 615 - protein, 904 aa, Homo sapiens
  misc_feature: Incyte ID No: 2789525CD1
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 616 - protein, 605 aa, Homo sapiens
  misc_feature: Incyte ID No: 1692213CB1
  unsure 596: unknown or other
GCGGTTCAGCGTTCRACAACAAGCTTCCAAGATGCCGCCCAAAGGAAAAAGTGGTTCTGGAAAAGCGGGGAAAGGGGGAGCAGCCTCTGGGAGTGACAGTGCTGACAAGAAGGCTCAAGGTCCCAAAGGTGGTGGCAATGCAGTAAAGGTCAGACACATTCTATGTGAAAAACATGGCAAAATCATGGAAGCCATGGAAAAGTTAAAGTCTGGGATGAGATTCAATGAAGTGGCCGCACAGTATAGTGAAGATAAAGCCAGGCAAGGGGGTGACTTGGGTTGGATGACCAGAGGGTCCATGGTGGGACCATTTCAAGAAGCAGCATTTGCCTTGCCTGTAAGTGGGATGGATAAGCCTGTGTTTACAGACCCACCGGTTAAGACAAAATTTGGATATCATATTATTATGGTCGAAGGAAGAAAATAAAATCATATGAAAGACTGAATAAGTTTTATACATTTTGTTTCTTTAAAAGGTATTACATATTCTTTTGAGCTGGAGCTGCAAGGAAATACAAAAATTTTTAAAAAGAAAAGATATTGGATGCTCCTTGTATTCTGTGAAAGCTCTAAGTATGGGTTTGTAGGTGTAAGANAGGGTGGGG

SEQ ID NO: 617 - protein, 131 aa, Homo sapiens
  misc_feature: Incyte ID No: 1692213CD1
MPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 618 - DNA, 608 bp, Homo sapiens
  misc_feature: Incyte ID No: 015393.1
  unsure 57, 586, 592: a, t, c, g, or other
ccaggccctctgcttggggcccctgccccgccgcagccagtcccgggggcctacccnaacaccgcccccgggagacgcccttacgctctgctgcacccgcatcctcttcgctacctactgctctcggcccccgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagaatttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggcgctgctgaggtatcaggcagtggcagaaggctctangctgantcgctggctgcccctt

SEQ ID NO: 619 - DNA, 527 bp, Homo sapiens
  misc_feature: Incyte ID No: 001089CB1
tctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggaaaaaaaaaaa

SEQ ID NO: 620 - protein, 130 aa, Homo sapiens [sequence omitted]

SEQ ID NO: 621 - DNA, 766 bp, Homo sapiens
  misc_feature: Incyte ID No: 002484CB1
  unsure 27: a, t, c, g, or other
aacttccccaagccggaggtccctgangcgctctagcgcgctggccgcactcgcagcccagcagtcgccagtgcgcacgcgcaagattaggtggggcgccagagccggggcacctgcgcaggcttgggctgcgccctgctcggcgccgcacggctctgcgggttcctcccttcttccgagcctctcctctggccgccgcgcgggagagaggccgagatggcagatgagattgccaaggctcaggtcgctcggcctggtggcgacaagatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatgggcttatagtcaaaaaa

SEQ ID NO: 622 - protein, 126 aa, Homo sapiens
  misc_feature: Incyte ID No: 002484CD1
MADEIAKAQVARPGGDKIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 623 - DNA, 1019 bp, Homo sapiens
  misc_feature: Incyte ID No: 669671CB1
cggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccgggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaacctgtaaaaaaaaaaaa

SEQ ID NO: 624 - protein, 248 aa, Homo sapiens
  misc_feature: Incyte ID No: 669671CD1
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 625 - DNA, 1588 bp, Homo sapiens
  misc_feature: Incyte ID No: 1344185CB1
  unsure 7, 19, 25, 32, 45, 59, 88, 96, 108, 116, 124, 150, 167, 181, 191, 216,221, 226, 233, 246, 264, 276, 286, 303, 307, 315, 330, 332, 336, 351, 359,363, 373, 377, 382, 395, 407, 424, 431, 435, 442, 446, 470, 488, 492, 499,504, 537, 551, 556, 583, 592, 596, 604, 615, 641, 671, 696, 709, 714, 726,738, 747, 751, 756, 762, 774, 810, 842, 844, 906: a, t, c, g, or other
ttggggntttaaacccccnaagggnttttttncccccaaagtttnaacggaactttttnttaaaaaaaccggaccgggccccaatttngaaatttnggaaattttttnaggggttngaacccanttttttttgggaaaaggggggctttnattggaaccgtttccgncaaatttgccaacnggccggtttnaaccgtttaaaaggcctttccgggnaaaanttttncgggggnctttggggaaagnccaaccccccccttttgnggggaaaagaancgggtttttncggccccccggaaaccnaggnccaatttnaggtttaaacttttngncccngggccccccaaaagnccccaaangggncccccggggngggncgggncccaaaggccccnaaaccccaattnggcctttaaggggtttnaaaaccnaaanggcccgnaaanctttgggggggggccttttgtttnccccgggggaaaactttngaanccccccnttttnggggccccccttttggtttcccccccttttggncctttccgggtttngtttngcccccctttggggggggttttgcccngggcttttngggncccccggnaaagggggccnggtttaacccccccccctttttcccnaaaaaaggccccccgggggaaacccaaaanccccccccggggggggcccggaaangggggaaaccggnccaancccccaaggccnggggaaaggggnaaccaattngggnccccncaaggnaatttaaccttnaacctttccaaggccgggctttggccggaaaccaanctttaaccatttccaaaacccctttccaattncnaaccccaaggggccaaggaaggaattaattggggaaaaaaaccggaattctttaagcccccnaaggaaggaccaacttggattttttcaaggaacccttctttggaattggaggaggaaaaggccaccaggaaaaaattgtttccgaggaagctccataaaagccctgtcgcgacccgctctctgcaccccatccgctggctctcacccctcggagacgctcgcccgacagcatagtacttgccgcccagccacgcccgcgcgccagccaccatgctaggtaacaagcgaccggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattcaaaagtg

SEQ ID NO: 626 - protein, 97 aa, Homo sapiens
  misc_feature: Incyte ID No: 1344185CD1
MLGNKRPGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 627 - DNA, 538 bp, Homo sapiens
  misc_feature: Incyte ID No: 697785CB1
cccacgcgtccggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaa

SEQ ID NO: 628 - protein, 135 aa, Homo sapiens
  misc_feature: Incyte ID No: 697785CD1
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 629 - DNA, 2818 bp, Homo sapiens
  misc_feature: Incyte ID No: 336435.2
ccggcagcctcacgcgcgcaccgcgcctccgccccgtccccgcgctccctcctgcccgcccgccccggcccggccccgccccgccccgcgccgccgcggcccgtccactgctccccgcgggccagagccggccgagctgctgcccgccggggctctgaacggctcggcggggccgggagccaggaccggccgaggagagtggcggccccggacggctgccggaggggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccacggtctccacagcactcctgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccagccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctgtttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttccaggacccctgggtagaaggcagcagtgc

SEQ ID NO: 630 - DNA, 1145 bp, Homo sapiens
  misc_feature: Incyte ID No: 231558.1
  unsure 693, 1065, 1118, 1130, 1132: a, t, c, g, or other
aagggaaatcgaacaaagacagtatttcaccctgggctggcaggcagctgttagaggtatttacggccttgccgcagtgcggcggccaggcagtcgggtagggtatgcgggggcaccggaagctggggagaagccatgaagaactcagaatttcaacttaaattcaatttagggtcacgttttcggaaatggcgtgaacagatgccctctttctagggactggtcctttagacttgatagttttgcagaatgagggagaagttgtgctctctggatgtaggatggttttccccgccttgaagaacgactcaaagggaagcggtgcccaagatgtgacatttctgatccacataacaaccttcagagtgttcattggcaacgaggagatgctgcttgttcggcggaatagggtttgcaaatcagaaaggacagttgaagcttttaatacatgttttcctgaaaaagaaaagtgtgtttcctgcttcttgagatgaggttcccaagctcctctgcatccaggcgtagaagcagtgcgcggtaccttatccgcactgcgcggtgcaagccggccgcacagctcacggtcccgcagcgcccgccacacacccgcgccagaggtccagcgcatgtgcagtgaaatggcctagcccgggaattcgatcggcaaagcacgggtgtgggggcgggggggtnggggggggcgagtggactcgagcaggaagatacacccgatctttccattctccctccgtcaagcctcgctactcatcttgcctttatctcagccttccctgtatagctgaacagttctacctttggctacatttccaatcattatgacttatcacctcaccccagtttaaatctgtacgctagacataggctgaaaatacgagacgagggccaaaggaaacactcttctttccagtttatatatatatatagcatatatttgcccctcggggaaggctgtagatttttttttttttcagcctgctgctactactttgggaaaaggccttttctcctggcgcctgttcaaaccgccacacttcaggccaatcnttcggcctgaccattcccggatcttgttatgccagcacagcacattcgagggntctggggggcanangctcggcgaagag

SEQ ID NO: 631 - DNA, 1867 bp, Homo sapiens
  misc_feature: Incyte ID No: 247784.3
  unsure 418, 1245: a, t, c, g, or other
caaaggagttgcccggctgtgcggctgaaagcacgttaccagacaatgagcatcttgcccatggagctatataaagagtttgcagagtatgtcaccaaccattatcggatgctgtgtgcagttcttggagcccgcccctgaatgtcaaaggcaaggaggagtttgccagtgcactagttcacatcctgcagagtacaggcaaggccaaggacttcctttcagacatggccatgtctgaggtagaccggttcatggaacgggagcacctcatattccgcgagaacacgcttgccacctaaagccatagaagagtattatgagactgattggtcagaaatacctcaaggatgccattggagaattcatccgtgctctgtatgaatctagaggaaaactgcgaaggtagaccctatcacangtgcacacgcatccagtttggcagagccaccaggccaacctgcgaatgtgctgtgagttggccctgtgcaaggtggtcaactcccactgcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcatggctggctgcgctgcgcagagcgaggccgggaggacatcgcagacaggcttatcagcgcctcactcttcctgcgcttccttctgcccagcgattatgtcgcccagtctctttgggcttatgcaggagtacccagatgaacagacctcacgaaccctcaccctcattgccaaggtcatccagaacctggccaacttttccaagtttacctcaaagggaggactcttcgtgggccttcattgaagatgatgtttctggagctggaagtggggttccatgcagcagtttgtgtagtgagatctccaatctggacacgctaaccaaacagcagtagctgtagagggttacatcgacattgggccgagagctctaccacagctgtatgccctactactgggaggtgtctgccccagctcagcaaggaagccctcctgaagctgggtccactgccccggctcctcaagcgacattcagcacagctctgaggaaccccaacatccaaaggcagccaagccgccagagnttgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacattacagaggtgatgggcctggtggccgcctcaacagcagcagtagtttcgaacctggcggccgtaggggacctgctgcactcaagccaggcctcgctgacagcagccttggggctacggcctgcgcctgccggacgcctctcccaggggagtaggctcatccatcacggcgagctggcatgcgcctcagccagatgggtgtcaccacagacggtgtccctgcccagcaactgcgaactccccctctccttccagaaaacccctctcttccacatggctgctgatgggccaggtcccccaggcggccatggagggggcggtggacatggcccaccttcctc

SEQ ID NO: 632 - DNA, 4286 bp, Homo sapiens
  misc_feature: Incyte ID No: 238322.6
acagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgccttcgggtcttggtaccgccactggacatccttcctgaagcttcggctcaactgctctgtccctggggactctactttctattttgatgttttacaggccttgactgggcctgtgaacctgcatggccgctctgctctctttggggtcttcaccacccagaccaataggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgcccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggaccctgggagtggaaccagaacaggaacaacgccaaggagggtccgggccgctcacggggcgggcacgcggcgggcgggcccgccgccccgcgtgctggtgaggccaccgccgcccggctgtcccgggcaggccgtggaagtcaccaaccctggaggaactgctggcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggtccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggcctcctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaatcttgtccttaggagaatttgtctggcagattttgggttgcatgaggggtaggctacaaaaaacagcaaagtattcgtccctattggaggcaagggtctgcccccagctcttacttaaggagcgggacgggggacgagagcgtgcgcggcgtcacacgcacgcttagccaccccccaagaagccgccgccgcgctcaagctccgcgcgctcaggaccaggtagcgtgtagctgtcgtgaagctccctttgctccggttgggactggctgcggatacctgtccgttatccccggcaccaatgagagggacgaacaggaccacctgcaccgcccaccaccctcgctaacaacgctttaaggcctaacgcaggcggcagctggtgcgaatttacaaatcgggtttttcacccccgcgtggctgcaatgtccgcccagttcgagccccacattctcccgctggctccgcctgggggtcgggccactcttgctgctaaggaagcctcaccagtccccttcccgtttgctacctaaatgtcctcggcgggaaactgctgagaacatttggggaagc

SEQ ID NO: 633 - DNA, 919 bp, Homo sapiens
  misc_feature: Incyte ID No: 055978.9
gagagtgggaaggtctgagtgtagtcagtgtagctcagctgacttacgtaagtctgaggaccttgctgagcctatttcttcattgagaaaactggataatgacccattttcacagggttgttctgagaaacaggatattactgtgaaagtgtctcgcatgtcctccagccctatgtggtggttttttcttacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggtcttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaag

SEQ ID NO: 634 - DNA, 5595 bp, Homo sapiens
  misc_feature: Incyte ID No: 055978.4
  unsure 4396: a, t, c, g, or other
ggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagctttttttataaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaanttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaactaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggggggccgtattaggaaaatgcaacactctctaataatttccgtgactagtaagagaaggaagccagttataaaacactgctggaccagaatgaccctataatttcctaagatcattctttatttctaatttaagatttttaaatttacttgccctccatgtcaggactggttagcattctgggcaaaaaaaaaacaagccggtcagttcactcagaacctactcagctttagagagagaaacagaagggatgatctggtgcccttgcgctatgtgaatatagccagagactgaggtaataaatatattttaaaataaaaatgacaagggatttgtacactgtaacactatgtagtgttacttctgctgttgcaagtatcttaactgttgaaagctaaactcaggaaatggagaaaatgtacataatatacattgacccattattttattctaaattgaaagtccaacttttagcagcagtctacctgcaactactgaacaccatcaggtttgagtccctaccagaatctcccatcatactgttatcccccatctctgtgaccttagggcatgcatgaaaacaaaagcaatctagtccctagggttggagactgccctctagacagtttttcatggcagaaaattagaatacaagtatacctcattttattgcattctgc

SEQ ID NO: 635 - DNA, 1116 bp, Homo sapiens
  misc_feature: Incyte ID No: 350977.1
gctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaaataaggcttaattaatgaccggacgacttgaaagcgccttccactgtatatctcttacctctgcaacgaaatgcaacaaaaacgcaagaaataaacactagaagccagtcttactgcacactgcagaagccaataaaccccaaatgtagctcaaaacaaggtgtcacgcaaacttctgatttttttttgttttacactgaatctctgtcactctgactggagggcagtggcgcgatctcggatcactgcaacctccgtcttctagagtcaagagactctcccgccccaggagtctctgtcactctgactagagggcagtggcgcgatctcggatcactgcaacctccgtcttctagagtcaggagactctgccgccccagcttctccaataggtgggattgcaaacaggcaccaccacgcccgaataagtttgtgaacatttggtacaaataacaaatgaccaagttccttggttgtagttgcctaacttttaatacttaaaaatgtagcctcaggaaataagaggcctcaaaaaattgaataaaaactcacaactttctctccacggaaatctttagtaaaaggcgaaagatttatgggctttgaagagaaacccgagtatattcgtgacttccgcttcgaacctcgcagggagaactaacacttaacacacttatggttgttggatgcctgcgtggtacgcactccctatatgtagtttatgcacacagatgcgtgtaagaggcatcatgctctaaaacagtgcagaaatgcgcgcacagagggagtgcaagcatcttgagggtatcttttcgtggtgcaccatgggtatgcaaatcacaggcggctccgggctgttccgcgccaccggggaagccatgggtcactgatctcctttgctctcctatgctcctctctgctggtcctcctgggac

SEQ ID NO: 636 - DNA, 3034 bp, Homo sapiens
  misc_feature: Incyte ID No: 238877.11
tatggcgcctggggggtttagttctagaaaagatatttgtattttaacttttccatctaacaaacagtagcacaggcatcttagtctggacaacaacgtacaagctgaattcctggctagttccctcattatcaaaccctgacacagtagtaggcgggagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaaaatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctg

SEQ ID NO: 637 - DNA, 2496 bp, Homo sapiens
  misc_feature: Incyte ID No: 238877.8
taaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatacatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtaaacgggtacaggtcaagggtaacaccagtcaaaatgtcagtatctaacttttttatttataaattttgtttttcttgacgaaataaactttcctttttattttaaaaatttaattcaaatcaacttttaaaataatttttcagcttagtaccatacagttgttgtccagtatttttagaaaagtaaagtcttagcatgaaacttccttaacctattttagcctcatgcttttgactaaaatagacttaaaaactgaattaaatttttatatacacttatatttaattaatctaaagagatagcttacatatagaaattaagtaaaggggagatctgtattttcattcaagatgttaaaggctagcacagaaattttctaggcattaaatcattgcttattacataatgtttttaatagtttgctttgatatcagtattgtgaataacggagcaaattcagccatattagttctgttgacttcatgctcataattttgagaagtccaggcgtaaactaaaactcttttggtgtacttgaatattctttgtttgttgatgtaaaatatgtaatctctgattttatagttaacaataaaaataaaattttaggtgagtgaaagcagtgatttaaatttaacagtgtcctcttgaaaaaccttaatcacagttaagtgatggcatgggcaatgaattttaatcatatttaggaataaaatactagatattagtgtataacaattagatatatgttaattgagcactacaaagcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggc

SEQ ID NO: 638 - DNA, 1027 bp, Homo sapiens
  misc_feature: Incyte ID No: 997231.15
  unsure 1019: a, t, c, g, or other
ctggctcagttccgccatggcctccttgggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattagctaatttattctacaggaagcaaaaggagggtaattttgatattgtctctggaactcgctacaaaggaaatggaggtgtatatggctgggatttgaaaagaaaaataatcagaagatctgattgttttatttggcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctngcctaatg

SEQ ID NO: 639 - DNA, 1084 bp, Homo sapiens
  misc_feature: Incyte ID No: 997231.16
atctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagtattgctgccttaaaaaaaa

SEQ ID NO: 640 - DNA, 5185 bp, Homo sapiens
  misc_feature: Incyte ID No: 346209.3
ggaactacgtgccggtccaagagggaacaggaggtgacggagctgaagaagactctggaggaggagactcgcatccacgaggcggcagtgcaggagccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccgcggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctacagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctatgtctgtgtccgtccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 641 - DNA, 1790 bp, Homo sapiens
  misc_feature: Incyte ID No: 2515666CB1
cagccattacaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccacagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttgggaggccaaggttggaggatcatttgagcccaggagttggaaagcagcctggccaacatagtgggaccctgtctctacaaaaaaaaaa

SEQ ID NO: 642 - protein, 504 aa, Homo sapiens
  misc_feature: Incyte ID No: 2515666CD1
MALSQSVPFSATELLLASAIFCLVFWVLKGLRPRVPKGLKSPPQPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 643 - DNA, 1759 bp, Homo sapiens
  misc_feature: Incyte ID No: 2742913CB1
cacactgacgaggccatgattgaatttaggtgacctatagacgcgctgtaactacgctcggaattcggctcgaggtcacctcctccccttgtcgcctaggtccacccgagccccctcccccgggccgcccacgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattctaaaaaaaaaaaa

SEQ ID NO: 644 - protein, 260 aa, Homo sapiens
  misc_feature: Incyte ID No: 2742913CD1
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 645 - DNA, 1344 bp, Homo sapiens
  misc_feature: Incyte ID No: 336615.1
ggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttgtgcaaaaaaaaaaaaaagg

SEQ ID NO: 646 - DNA, 1350 bp, Homo sapiens
  misc_feature: Incyte ID No: 406830.43
  unsure 279, 636: a, t, c, g, or other
agctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaaatgactcagtgggtttagtaccaaggtagcagtgttccatttgatgattcancatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgacggtgtacagttaccatactggtaacaagtcacnccttttaaacgtgaacacatttgactgaagttttcgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaaggatgc

SEQ ID NO: 647 - DNA, 296 bp, Homo sapiens
  misc_feature: Incyte ID No: 406830.33
gcttctggaagcatgtttcctgttaaaaggcctagaatatcctgcagtggtagagtttgctccattccagaagatagccaaaaagaagctgagaaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgagaattcgagaagagaagcgagaagaacggaggaggagagagttagaaaagaaacg

SEQ ID NO: 648 - DNA, 309 bp, Homo sapiens
  misc_feature: Incyte ID No: 084685.1
gctcgaggctacttcttaatggagacagagaggagtatgttgagaatccaaaagatttattgggttgtcttttaatagttccacattttgtgataaaagttaatgggagactagctatagcaacccaaaaacacaagaccgcacatcgcttcaggaataaagggctcttcaggaataaaagttgaggtcactagtatagagtcttgaatgtcaagagttggagaagctgagactttactgcaagttaacaagttagcctgtcacagtttaatgaatgttgccaaatggcatgagattcttgggataggc

SEQ ID NO: 649 - DNA, 843 bp, Homo sapiens
  misc_feature: Incyte ID No: 1045907.4
  unsure 610, 651: a, t, c, g, or other
agaaatgaataaactgaagtttctaaatattttctttctgtaccacagtgcaccccacttaggagttggctggaccagaacaggggagacagaggaatagtttcagcagcacaaacgctgcgagaacccaggtggaggcccttaatctcacctgaagaggtcaaggctggcgtcgcagaggaggcagcgctcatcctggattttgaaggatgaactgaattttatcaggtagaaagaaagaggaaaacataagcttttgggtgtggcaaagttgtgggcattagaaaaaggattctaatttcctttacctcccgcctctccgaaaggagtatttgtattggtttccaagtagctgttctgcatcataggagaccccagcttattcctcaaagttcacccaaccctgaatataggtgaacctggagtgccgtcagtgggtagaaggggaagaggagtaacctaggagagatgggggaaccacctcatttgcatgagagtcgtgcccttctcccctgtagcctgagtttcctgcttccctctgctccacccagctcatcaggagagagcccactacctttcttacctctaagaagcagacccatggggggantggcataggtgtgtgcatgttgggatgggagagggatttgntgctggaagaagaaaagttgggaaaggcttctgaataatgaaaacccagaatttcatagaagtcagctcattagtcagccttagctttcgtactttctccaatgggaagctcacctcctcttggcaccaggttccagctgatagcactcattattagaagagcactcttgtttcccattaaaccagcatatg

SEQ ID NO: 650 - DNA, 636 bp, Homo sapiens
  misc_feature: Incyte ID No: 1383803.2
gcgggcacttccgccaggatagcccaatgacagaggtgggacagtttctataaaagcttgagcctcgcccgcccctgtcttttcggggtcgagtccgagggggaagaggtttgttaatacgttcgccatgtggctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaggtgcttagcaataaagaaaggtagtgagttga

SEQ ID NO: 651 - DNA, 551 bp, Homo sapiens
  misc_feature: Incyte ID No: 085282.1
  unsure 132: a, t, c, g, or other
tgaataccaatactgaaaaattgtttcttgcctcaccttgtcctatgaacaggaattaaattttaaagtattgccttaagatggctgtgctaaataataatcattgcaagagcaatacttttacctgtttcnagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggtttttttaaaaaattgagattcaacttacataccataaa

SEQ ID NO: 652 - DNA, 1396 bp, Homo sapiens
  misc_feature: Incyte ID No: 086326.1
gtatatgttatataaaaggtcacttcctcttgaatttgccaaatagttgtttgcttagcacgaatgccaacaatatttttttaaatttaaagatagcctactctcatatagagcagatttttttaatatataaaaataattccaaattttattttattttctgttgcaaaggcaaataatcttggaagtctcttttaaaagttaaatcaatgccataatatactcaaattgtcacaaagaacagtctattgtaacaccctgtgatttactgatagcaatgaagagtgtggactttggggccaggaatccttgcttcaattattagttctactacacactaaccacacgatcttaggctaatgtcttaacctcatttcctatctgcgtaattgcataagaatgctatcaactcatgagtcagtgctcctcaagtgtttatgacagcgataatgtataatacaataagaactcaccaaacgtctaagacactatttcttaaaaatcaagacagtgaaaacttcttccttagctgtccgtttttctgctacagtaggttcaaaattatttttcaggtagccctacccctgtataagctattcatctgacctctctcagaggagctggaatagtcctctcttcagaacatgtccatgttgtggtccttgggtcccctaacccttctcccttctcatctgtcagttaaggctttgcctttaaatgctaacatagagctacattttaagagcccataattcaatatggaaacaaactccctggcacactctatttcttgaaagattatcaaagagaatcaacaattggaaggaagtgttgccgagaagctagttgcatcaaatggtttctctacaggaacttttgtagaaattgcacttgcttgtaatgccactggtctaccctgagagactttttaagaaaaaagagatcctaaacctttgaagatattcactccattacacagcatcttctttttgagaacccttaggacacaactttttttctgatactaatattagaaatactgtcactttactgtatttggtgtttgtcttaagggctatgtgaaagacatgatttactagattttcttccctgagttttctgttaaacagcttagaggcaaaattgtggtcagtttatggcaattgtatagaattgtataatataaaattttgactagcctcatttgtgggtggattttcatgttttatcttgtatttgcttacttttcttaccttactcaatttattctatttaggtgtattgtacatttcttataaagccacctgaatttgcttttggaacaatgtgacttagtatttaataactatgtcacttatagtggaaattataagcctcttcataattttataaagta

SEQ ID NO: 653 - DNA, 1230 bp, Homo sapiens
  misc_feature: Incyte ID No: 337470.1
  unsure 549, 567, 631, 668: a, t, c, g, or other
gatgtatataattattaaattgtacagatgggaaaattgaaattcagagagattaaatacaatgcttgctctgtgttacactgttagtaagagagcaatacatgaacccaagtttgatcctcaaaatcacacttttaattacttgatacataatgtcttccaatattgaatctagactagggcaaattctcagcccaaaaccacacttcaatttagcaataatgtcgtgctaggacatgagagggattaacattgaagacacagcctctatctttaagtaattcataatttagccaaatatattaaatatctgtaatataaaacttacctaggaaagtaaaatagagatccaagaatcaggagtcctaaagcatataatgagtctgttcctcttggaagccacacatgtcaaggtcatcagtaagcaggcctactctttcttcatattctgggttaatgttcaccttgactgcttggtaaatttccctcactggtgctgaagtaaccaaaatggggaaggagtgatgaaaactcatctttgagtaagcntagtgggaaatagtatanctgggccctatagagaagttgggtcattacttagaatgacaactggaaaagtacatagactgcntgcccatcagtttgttgtaccatgtacctgttcacanactcttttcaaaaaacaagtttattttactttttttggtactttggtcatgttgtttccttggtaaagatcaaagttgaataaagcttaacaaagtttaataaagaaaaggaataaattactatctaaatgtgttaaaagcaatcaccaagtttaatcacttaaaaaataaatattctcttaacagaaatgtcagcggttacttacaatgcttagcagctaaattccatgagtataacgtttaatgtctttttggtacattaaatattcagtgcctttgatgaagggaacaaactgataatttcattcatgtgcagcaaacatcaaggttacataagtaaattcaaatgtgtcaatctgtaactgtatggagtcctgtattaaatcaagtgataaaatgtacccttctcaaaggctattcatgaataagcataaccttcaactgaggcctgaatagtcatgtgtcagtagggtttttgttaacatttgtatgccaaatttattacgatagactgtgatagagtagaagttatgctagcttgaaatcagaaaactcaacagtg

SEQ ID NO: 654 - DNA, 1987 bp, Homo sapiens
  misc_feature: Incyte ID No: 3721108CB1
ggctcgaggtggcgaagttacttttgagggtatttgagtagcggcggtgtgtcaggggctaaagaggaggacgaagaaaagcagagcaagggaacccagggcaacaggagtagttcactccgcgagaggccgtccacgacacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgcaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggagacgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaa

SEQ ID NO: 655 - protein, 461 aa, Homo sapiens
  misc_feature: Incyte ID No: 3721108CD1
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVETLLSYTRIKRPQDQLRFPRMLMKLVSLRTLSSVHSEQVFALRLQDKKLPPLLSEIWDVHE

SEQ ID NO: 656 - DNA, 1675 bp, Homo sapiens
  misc_feature: Incyte ID No: 1090929.2
aaagtgattagaagtcaggtatgggaaggctaaataggacagagtcgagtacatcctctgcttggaaaaacatatcaacacccttttttttgaacattatatcttgttcataaagagaaaactttccacattgttttaacaaaccccacagctgagagtcaggcctgaatctttgatgtgtgcccattcacaacgttgaccctattggtttgtggtggggcagggcatcaaaggacatcattgactaatcacattcccctgaatagcttcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatggggaaataatacatctaataaatcaaatgttccaagacttcaaaggtcttttgggaaacaggctatgtaaaacagcacactggtttcaaactttggtaaattttaaggaagaactcttacaagggcatttaattcttataccataattttccagggggaactaatccaaatcagctaatccatggaagaccatggattttcgttttagaaaacacttttgaaaacttgggataatctcatgccttaatgatcaaagcattatgagaaggacagtggtttttaacctggggcatacgttcttaacacatttactctccacttattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttctggtctacgctcattccgttgatgatcttagatattctctgcattaaatatcacctctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgttaagtgtcaagaaaagattgacattttgttaaaagttagtagtgaagtgtgtaacgcttaagccaaactttcatatttcaaatctctttagcaagtgtaactacttttttcaagatgtgaaataatcattaggtcagtcatttgtaaatagtacgggctgctgtggggctttttccagttcttcaccatcccatttttataaaaactcttattgttaaaaaaaaaagttattccagaatttccataaagcccaaacaccctgatttccaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaaaaaa

SEQ ID NO: 657 - DNA, 816 bp, Homo sapiens
  misc_feature: Incyte ID No: 095374.1
aagaaacagtcaaagtcattttcacatgtagatattgctcaacttgtagaatcacagaaggactgaggagaaaacaaaatacatctgcttccccttctggaaatcaagttaatattttgaagatttagattgtgtcatcatatgttggggctggtgtttactccacctcacctccctttcataagggaggagaacggtgtcatttcctctttccactgggttgtgttttgggacttcttggtctcatggatttcgccttcaatctgattctgtctgcatagcatcttccagaagttcattgatggttcaaatggaatcatttgatggttcagtgatggaatctatcctgtttgccttttttttcaatgcagttattcttatttatacttatttacattccctccacattcaataatattttgagaagaagaagaggtacttcatatattcacccaccatcttgagataaagccacattttatctgagtgtgttcaggctcttagatagtaaagatagtctgtagttcactgggcataaatctgcatttatgattataatgcctagctcctaaatctggaaattaaataaaaaacacaaaattaatgtagtctattgtgctcatatttaatgcatgtaaaactgtgtctgcttggctagccacttagaaaattatggtatgaaatatagtctgttgattatgaattcttttcatgattatttacagacattattagaatggaagataaaagtatagaaaatgaaagacatcattcatgctggaatttttctaataataaacacttgtaaatgtccaa

SEQ ID NO: 658 - DNA, 735 bp, Homo sapiens
  misc_feature: Incyte ID No: 238639.2
gcaagcggccccttccttcggccccgcccagccccgccggccgcccgctccctggggaaccgagggaggaatgggcggggtcctcaggtgcccggcgacgtcatccagcccccaaggctccaggacgcaaagggtcccctgatctggcagtccctggacctaccctggagagcgtggggggacaaaggccggacgcgccgcccgctgccgcctccaggaagccctcccttgccaggacagtggagttggccgggtccttccaaagtgcctacggaaagctttgtcccatccttgaaaaattgctaatgggtttggagatacgaggtggagatgactagcaatcaaactcaaaggtggaagtcacatcgaggcagatgagcagatgaggggacctagagaagaagagaggtgcaaggagagcccagccagcaggaacatctgccccagtaggcagcactgccccacatcagagtcgaggaaagcaaagctcggattggataaaagaaacttgcaaacacggtcagtgcttactgcatgtgggctcagagcacgttaccctccttccctgcatgttcctgtgaaacgggtttactgctctaactctcagggacactgtgaagaccaaacgagaaaatagaaacaaacataatttataaaccataaagtactgacaccaaaagaggggcgagcacagcattgtgaatgtgctggtactaaatggtttgttttaagatg

SEQ ID NO: 659 - DNA, 3502 bp, Homo sapiens
  misc_feature: Incyte ID No: 033627.28
  unsure 31, 2598, 2666: a, t, c, g, or other
aagccatcaagtattcctcggaaatcatctntggatctcaatcaagttagcatgctttctccagctgccctatcacctgccagctcatcacaaagatctggaactcctaagccatctactcctacaccaaccccttcatcgaacccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaacccacggccacccaggtcatggcaaactctgctggacttaacttcatcaatgtagtgggctctgtttgtggggcccagggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttattgcagtcacaggcagctggtaggtatcttcataactttatattgctgaatttactaaacatatctatctatttgggatctcaccgcttaaattattttcttttccttcccttgcaaccagtaaacaggaaaaagtaaagctataatgtgtaaactattaaattgattgatggctgagattttttttcattgatagtggattaagagctttgacttaacataattaccacagttgtgtttccttgttacagtttactggcaaaataattatccactttactaggttaccagagctgttttcagtgtttgccaatagttatcttaattaataacttttttgttttcctgggttaagactgaatttttctagattgcataatcttttgtctcgttctggtaacttgtagttgcataaatgacttaagtcttaatggtcaatagcataacttctgtaagtcacttttatcatttaaaaaaaaagattaaattacttctcaacacttccagcagtaaatggtgaactaaagattactcttaatgattatcctgtcagttgaagacgataattctaacttcctgtcagttgaagacgataattctaacttcctgtcagttgaagacgataattctaacttcacacttaattaaaagagtaagccatatgtataagaaaactatgataagagtttgaggattgaatgagtgactgtgttgtcagcatcttatcactgtgggcttactatgatgcctttagaagtcttttagaatgataatctttattttggaagtcagttatccttacatataaagttccaatttagaggtagtgaatttccaaatagaagtttatataatcatatacctttatcagaccaattgtgaatttccgaaaatagctgtagtataatttagtggaaacaactctagtctgaaaaaaatcatgagaatgttcttagccacagactgccatacttaactttgagtctgagtcacttaaatcatgttggccttcaaacttccccatatgtaaaatgagtgttgaactgattactgtggtcccattcagctaaaaaaataacaaacaatgcttagtctcagttcaccacctttattgttagtagagtagtctgatattcattgcagcatcttttgtttaaagcaattgtctgtctaccagctttgttgttacaatagtttggatttcttccatctcccttctcctactttgttggttttatttcaaaaataatatactcttctaaacaaaatagcatcaatatcaaattttatacagatgcaagagaagagaggttcagtgctttgatacataatgcactcccttctctttttgtgtccagaaagttccattatcagtggtacccccaactaacaggagaccatatactaaatttattctgaaatgtctatgatttgatacttaagattaatcatactgctaacttttctattatttcattttctatgttgtccttttctaaccctggtagctttcaaactttttgactggcctgctttccccttctcctctctgtagtgttgtctcagcttggctctgccgagaacagacctgagcaaagccttcctcagcagagattccagctctcctctgcctttcaacagcagcagcaacagatacaagtaatccagcaacttcactctgattacatttttaaagatactcagctccaaaagtacctacaaaataacttgctttagttttattttactgtcttttaagactgtacagtaattggnaaataatttagcaaattttaaagtctgacattttagccagtcaacttggagcactgaatatattttgnatatttaagccatactctataaaatttttcatgaagtgctggtggcacattaacatacatttttctagtatgcagtatattttgaaagacagttgtaagtgccaattgttaactttctaatattttactgcagaaaagtgttcctattagtaaatgtcatacctgtttatttagaaaaatgttataccataattttaggaaggaaagtcagcatattatagttgactatcttgatattcagggttgttttatattgctataaaccatcattatacaacaaaatggtaactgaagttgctgagttactacaatatagactggcagggcaaagtaacaaataattttgaagtttgccaagaatcatttttaaagcccttagcaggcttctgtgccactggtgctgtttgactgtgcattgtctcaatgtggtatagtccctttttgttatcttggtgctttctccctttttcagttgtgttgtttcgtcactcaggaaaagcacctttctacacctgcctgcatttaacataactcgatttttttccctcccttttgcagcagttgcgattcttgcagcatcaaatggctatggcagcagcagcagcacaaacagctcagctacatcatcatcggcatacaggcagccagtcaaaaagtaaaatgaagagaggcatgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaacctt

SEQ ID NO: 660 - DNA, 3887 bp, Homo sapiens
  misc_feature: Incyte ID No: 033627.33
  unsure 2483, 2486: a, t, c, g, or other
cggggtccccagagacccggcaggccggggcggaggttgaggcagctaaactcccggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagccagcacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagnagnacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaatgtggtggctgtttatttgggtttcatactcttaattacttcatccatcagttttttaacttctttgtgtcttgtaactgctcggctcatacagtcctgaagtttagctccagttagcccacttccacctggtttgtgaagacaacagagtttgccttcctcatccattactattgttaaggttcctgttgccagatgttcctcctctccagtagggtcaactataagcaaagtgtcatcaaacacagcaaaggaagttgcaactggatgagttctaatattcaaataacttttcttctttaaattaacttctgctaaagcagtttcttcatttatagtaacttcaggcaactgtacattttttaaagccgctagcaaagcaaatgtgcaggcatccaaaatgtttccatcgtagtcgaggcaaatgagatcacagtatagaacccagacaagctttcctggagaaatgcataagtcctctttctgaattatctgtgaattttcaatgacatctgcaatgaactggctagccacttgggcctcttctccaggaggtccagaccggaatctcgatgaacacaggggtggtagatccacattaggaacaacgtatcctttatcaggggcatctgttgatggtgctgcaaattcctggacaggttactgaaagtcattgctttaactccacagattactgtagtatttcccaacttcactaaagcagaaccatctgcggtactaattgaaccgatgttgacagttgtggttctgaattcaccaagttctcttccatcaggacggcagttctctttcagaaatctcctgtaatactccagaggttccacggttttgaaacacgtgttaaaaatatatttgagataaactgatgaatcttaacataaatccagaaattggcaaagatcttaagtgtggtgatgcagcataaatcc

SEQ ID NO: 661 - DNA, 2559 bp, Homo sapiens
  misc_feature: Incyte ID No: 435361.10
tgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatccagttgggttgcacattgtgtggtcgtccaaataactcaatcttgcgagtgccaggagatagtctttcaatcatgccatagatttcatctggtttatgactggtggaacgaacctcagctacgatcacatcacaatccagaccctggttgaagccttggggatttcctttgacaccaaccaagcagtgttccttcccatggttcaaccagtgacctgtacggcctgtccgaatgatgcgttgcagttgatttgtcttcacccaaataatttcatctacccgttcatacccccagaggtttagacattctctccccaactccatggcaccttcttgctctgttgttccttagtggactgttggttcagaaggctctctatctccagatcaacatctgaggcagcatgtttccttgatttcttggctggctcctttgctggttccgatgctgaagagttcagaccagagactaacgaac

SEQ ID NO: 662 - DNA, 448 bp, Homo sapiens
  misc_feature: Incyte ID No: 474552.1
  unsure 391, 397, 415: a, t, c, g, or other
ctgccgcccgggcagcgctcatgtgaccctccgtggattaacatcctgctaaaaaaaaaaatacctctgctttcttttttcctttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcagggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtnccggcngcctgctccctgcctctnccggcttcctctctctttatccggcctctctct

SEQ ID NO: 663 - DNA, 1212 bp, Homo sapiens
  misc_feature: Incyte ID No: 2636759CB1
gacggcacgcaaggtcagcgtcacagatctgaccctaaaaataggcctctgttgccagtcggggtggctgggcgtgcggctgctacatgccccacggaccagaacctcccgacgcggccaggccccggcacacccagctgcagaaaggagagaaaatcccttggctctaaaatgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgttggaacgtggacactgggccccgactactaccgcgacatggacatccagtaccacggcgtggaggcccgacgacctgcccacctttcgacctcagtgtcttcttctacccggcggcagccttcatcgacagagcgctaagcgacgaccacagtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatgacagggagctgtaggcccgactcacagggccagcagaggcacttggggacagaggggagaggcagaacatagccctggcctaggactccagagaagggatggtgaaaccgaagctcgactcttccaaaccatcttgttcaacttccccatgtgtgctggggacagggaggacccagagctgcccccgggcagagctgagcgctcagcctctcagcaaaatgggagggacgggctccccggctctgggtcacagaggagcatgccacgctgcaccaagtcccctgctttggttttgtttttttggtgagaaggaagagggaaaattttttaaattgtggggcattatttttgtaaatatccttcgggctttgtttaaaaacaaaaaaaaa

SEQ ID NO: 664 - protein, 221 aa, Homo sapiens
  misc_feature: Incyte ID No: 2636759CD1
MTSGEVKTSLKNAYSSAKRLSPKMEEEGEEEDYCTPGAFELERLFWKGSPQYTHVNEVWPKLYIGDEATALDRYRLQKAGFTHVLNAAHGRWNVDTGPRLLPRHGHPVPRRGGPTTCPPFDLSVFFYPAAAFIDRALSDDHSKILVHCVMGRSRSATLVLAYLMIHKDMTLVDAIQQVAKNRCVLPNRGFLKQLRELDKQLVQQRRRSQRQDGEEEDDREL

SEQ ID NO: 665 - DNA, 1075 bp, Homo sapiens
  misc_feature: Incyte ID No: 1083665.4
ggtatggtttagctttatttttttactacttttactgtgtgatcacttgtttccacaaatagacaatactattttagttaaagactcttgaatatgttcttggccccaggtaactaaagatatgcatgcttgagcctgaaatactttttagttagagcttcaaatagcatttataaaattcattctgcccaaagatactgggcatagagactattgcctaattcaggagcaataggctatatacctcttctcattgatggatatagaccttttaaattttagttcttttaaatgctttacagtatttgatatgtaaatgtgatttctcaaaataaggtgagtaaagtaggtgattatttgtttaatattaactgtttatgtcattttcatggtgagctttccagtgttttaaaattaggtacagttttcattagtttagatgttttctgtggtttgggcactgctaggtactagagatacaaagttgaaagacccatagagtggaatactttgttatttgttttgaattttaaagatgttttaatactttgatccattgtggtatataaaactgaaatttttaattagctaattagtgtttatgtagctgttttcctcctcagctatagatttcatttataaagaagttgaaaaagttgtctccctttggcaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaa

SEQ ID NO: 666 - DNA, 652 bp, Homo sapiens
  misc_feature: Incyte ID No: 240518.21
  unsure 37: a, t, c, g, or other
tgggcaaggctggtccctgtgtgatgagacatcaccntcccaggagcaaggcggaagtctggaggacgctgaggggcggaggcgggagaggcgagctcgcgatgagtggtctcggcaggctcttcgggaagggtgagccagggtgggactggccagccaggaggcgctggctggtgcaggggaagaggagaccccggcgagattcggccggaccgctgcgccgggcaggggaagagaatcaggagacaggctgactggaaaaccccggcggccgatggcggagcaaggctcatcgccggtgccaaaaggcacaccatgtcggggcgccttgttcccgtccgccgtcctcccccactctcagagggaagaactcaagatctgggaggggacttgagttgagggcgtggcgatcgtgctgactcccactgttcaggcttgaagacgagtttcctgctgtcttcagccattttcaaaaccttgttctataatactttgtgctgggcaagagggatctaaggtgaagaaggagaaagggccaacccctgaagaagcaatacagaaactgaaggagacagagaagatactgatcaagaaacaggaatttttggagcagaagattcacaggagctacaacagccaagaagtatgggac

SEQ ID NO: 667 - DNA, 2015 bp, Homo sapiens
  misc_feature: Incyte ID No: 240518.42
  unsure 748: a, t, c, g, or other
tggcgcggctaccgaagctggcagtctttgatttggattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccacagtgtggggagtttctatttttctagcctgtgaaatggggttggttgtcctgacgtgcagagaccagaatgtgagacattagactgcatcaggtttgccatctaaacttagggcaaccccaagtgcttgaacctataccaccccactttcctgagctctgtaaagagcatgaagttttcccactgaccccatactctncgggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaag

SEQ ID NO: 668 - DNA, 4446 bp, Homo sapiens
  misc_feature: Incyte ID No: 001322.4
gcgagttgccaggcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgcttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgccttgagttt

SEQ ID NO: 669 - DNA, 1255 bp, Homo sapiens
  misc_feature: Incyte ID No: 208282.1
gttaaaaaccagtttagatgatgttaccaaatgaaaacaagtctgtattagcaaatgccacattatatttagtcgtattctcactaaattctccgttattaaaatgatttctgcatcttgcctggaaaatgcacttacatatttacaagcgttgtatgtcaatgtgcatgttttgaatttcctaacagtgtctaatcttagtagtttcatagtagttatgtaaaatctctttaactgcaaaatactataaaatattacttgaaatattaaagtattagtgccatttctagctgtggcaaggcacaagtcttactatagcttacttatgtcttctcatagatttcagtacagcatctgagtagtggatctgtttactgacagtatacacaaactaggtcttgacctcacttctttcttcatttaaaaggagaagatttgaaatagagctagtgtaaataataaataaaattatttaaatagcatcagtggctcaataccatctgttgaggaataaaataatttggttaacatacagaacatcgataatatacaataatgactttttaaaaaatgagtctgatctttttggctcacctagcttcccttaataagaaaatttgagaaacttggatctgaaaagtgtagttgtacttcctaacattaaattcctggctgtaatagttaatactttggcagcattatggttagtcttgtttatgccattggcacttactaggctaaactttctgaaactgattggttttgacctatgagataaggaaacatgcctaagaaatggctagaaatgctatttattgccctatgataagtgaaatagcaaatcactcttgattcttaaaatttcatattaaaattagctagttcctacatgcatgcgtgcacaagtatatgcagacacacacacaaatcagtaatctatgtgaactagatactaatactaaattactatttaaattgggtccagaaagatgctgttttgaaaagaacactaaaaatatttcattagcgttttcttgataacaaataggaaaatatatgtttacaccctgaataaattcagctgtgggtggatttttgtttttcaaaatgattttgttagtttgaatgaaacctaaatataacattcaagtcaattcttttaacatttttctttataacagaatatgaaaaacgctgtcttaaagtgttgtaacttttctgaattttcaataaaatattttgcttgcaaaaaaaa

SEQ ID NO: 670 - DNA, 330 bp, Homo sapiens
  misc_feature: Incyte ID No: 345272.5
  unsure 319: a, t, c, g, or other
gaaagaagtgttcgactacagttacagagattgcattctgtcctggtatggaaacctcagcagagatgagggacaactttaccatgtgctcttggaagacttttgggaaattgccagacagctgcaccacagactgagtcacgtggatgtggttaaagttgtctgcaatgatgttgtgaggactttactcactcatttctgtgacctgaaagtgctaatgccagacatgaacagccaagaccttttgtgttgcacgtatgcttgaggaactcagatgatgaagtaagatttctacaaacgtgttctcggggtctggtgntttgtctcctc

SEQ ID NO: 671 - DNA, 3209 bp, Homo sapiens
  misc_feature: Incyte ID No: 345272.2
ttcctgctggggatcctgtttgccctcgtctgccggagcccgcgcgcccagccgcccgacttcgccgccgcctggagccggctggccgcgacctcagccgcccgccgcccgccggggagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagcaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcac

SEQ ID NO: 672 - DNA, 648 bp, Homo sapiens
  misc_feature: Incyte ID No: 997613.1
cttctgtgcactgaggaggactcttgttacctggatcactctggccccctgggtccatcaaagccatcgccacccctgcctcagcccaccatgctgaagggagcagtgagcctgccggtgcgcggaaagcagggacctatctttgggaggcgagagcagggtgcatcgtccagagtggtgccaggccctccaaagaaacctgatgaggacctctacttggaatgtgagccggatccagtcctggctttgactcagactctcagcttccaagtcctgatgccctcaggccctctgcccaggacatcagtggtgcccaggcctagcacatgcccctttggaactcggaatgtaagaggctgatggtcaggggagaagagagggaggcagggagggaggctcagggtgggacctggggcccggcctcttctgatcagacctcctgtatgccagggaacagcagatgctgcctctaaaggtgagtaaaggctggtccaaaggtagtgagttatcccaactgattgttccacagtcagttacagatccaactccttgttctaccctttccccacttctcactactgtacttggctagtctacaaacacataataaacaactttaaaaactaaaaaaaaaagttaacaaaacag

SEQ ID NO: 673 - DNA, 1825 bp, Homo sapiens
  misc_feature: Incyte ID No: 231840.1
ggagcagcgacatcaacgtggccccgggcgagcagggtcccgaccaggaggagaccaacaccctggtggccaataccggcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaag

SEQ ID NO: 674 - DNA, 3205 bp, Homo sapiens
  misc_feature: Incyte ID No: 013937.3
  unsure 476: a, t, c, g, or other
agtaaatacaacaggagcgcaaaatggcggaaccgccgagccccgtggcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccccgctgcnctcgtaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgtgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtg

SEQ ID NO: 675 - DNA, 1626 bp, Homo sapiens
  misc_feature: Incyte ID No: 253783.6
gcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaaatcacaaaacaaaaaaaacaaaaaaagatgttaagatccaagcaacaaaaaaaaaaaccaaccaaaccaagaggcatccaaccaagtttcaagttcccgcgttcccggccacacgcccgcaccgagggagcacgccggcaggggcgccgaggagcggccccaggacaggacggccccaccgcgttccgtggctggcagcacagtgggaacacgcccctccgtctcaggcagtgggggagttggaggggaaggggcctcccttgtgggacccgtggggggctctgttttccatccagtcttcctttcccagcccccaattcccaagacagacagtgtggagcccagcggcggcggagcaggcccgggcctgagcaggcaggcgctgctagcaagacttgatctttgtggccagctgtgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggccgggggctgtgtacaccaaggctg

SEQ ID NO: 676 - DNA, 264 bp, Homo sapiens
  misc_feature: Incyte ID No: 020828.1
cagtgagcctctcccgacacaccgggggcgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctccc

SEQ ID NO: 677 - DNA, 515 bp, Homo sapiens
  misc_feature: Incyte ID No: 222705.14
gcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaact

SEQ ID NO: 678 - DNA, 367 bp, Homo sapiens
  misc_feature: Incyte ID No: 335906.1
gccagactggccccaaggtctaggcacagtgttggaattgagctcatttggcagcaccaggcctcagaggcacgtgggatacctgcctgcccatcctgttccagggaggatgctcaggctacccagcctctgcatggccttgcacagccatggcctgttccttgcatcagggttacctggtcctgcttactggggtccagcaaaagcaggagagggtcggggggccatgctaaggagccagctaggcctgctggatgtgggtccttggccccaagatctgcatctttcaaagccttggccactgcccagaaagcctcccaaaagtggggaagaggctggaggagcttgaccacagctctcaccaaga

SEQ ID NO: 679 - DNA, 2669 bp, Homo sapiens
  misc_feature: Incyte ID No: 1325741.20
  unsure 196, 205-224: a, t, c, g, or other
gggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcgncggcggcannnnnnnnnnnnnnnnnnnnatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaactttaaaataaacatttcactaaaccttttaaaaataatacatttgttttggattgtatagcacgaccatgtggtaccaatttggatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgatgcctgtactatgattggcacgcctaaaactcgttggccagttaatcctatt

SEQ ID NO: 680 - DNA, 2155 bp, Homo sapiens
  misc_feature: Incyte ID No: 2703282CB1
ctcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccgacattagtactctcaacttactttttagagggcgagaaacaatctgtaaaatggtttccatgcagggaaattctcggacctatgcgatggttcta

SEQ ID NO: 681 - protein, 208 aa, Homo sapiens
  misc_feature: Incyte ID No: 2703282CD1
MKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 682 - DNA, 6102 bp, Homo sapiens
  misc_feature: Incyte ID No: 118836.2
agggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcactttggcatatggcaaagctgctgctgtgggctgggaacatttgaggcaacagtgacttccttctttcctagttaccggaaccctgagagctgggagccgggcagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtcgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgatttt

SEQ ID NO: 683 - DNA, 7050 bp, Homo sapiens
  misc_feature: Incyte ID No: 003303.2
ccgggtcctgggcgagcgggcgccgtgcgcgtgtcccgcggccgagctgctaataaagttgcagcgaggagaagcgcacatcggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcatttggacaatgttgcaagaactctatttttgacatgcattaatcttttattttgcacttttatgggtgacagtttttagcataacctttgataaaatacactcaagtgacttgggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctctcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagatgcatttgcttaacatctctacataatatttatggtctggtcagtattggtctggtcagtattgcctggctgacgtgaaatgtaaactagtaggcatgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacgaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaggaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttacggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaaccttaaaaaaaaaaaaaagcgccgctcgcgatctaga

SEQ ID NO: 684 - DNA, 141 bp, Homo sapiens
  misc_feature: Incyte ID No: 092991.1
gttggagtatctaataaatgtggcagagtatctaacagatactgtcctcaaacaatcaacagtatattaaatgcctagcatatacctgaaagcaagttacatactgaaggtagaaaaagaaatacataaaaaaatttttgt

SEQ ID NO: 685 - DNA, 75 bp, Homo sapiens
  misc_feature: Incyte ID No: 093603.1
gctcgagttacactcctaattgctttaagcacttttttgtgtgtgtaaactgtaaagtctagcccagcccttgtg

SEQ ID NO: 686 - DNA, 1238 bp, Homo sapiens
  misc_feature: Incyte ID No: 1383062.7
gtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttgtgcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttaga

SEQ ID NO: 687 - DNA, 615 bp, Homo sapiens
  misc_feature: Incyte ID No: 1383062.8
agttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggttagaggtttcagagaatagatccccactgagcattcccattgaatttatttgttatttatggcaaagaagtagtgactta

SEQ ID NO: 688 - DNA, 528 bp, Homo sapiens
  misc_feature: Incyte ID No: 1383794.1
  unsure 440, 516: a, t, c, g, or other
gttattccccttgcattttacagccctgattttgcatttgccaacctctttcaactaagttcatgtcatcttttcccatggagtttcactatgcattgtcagactgctggttaggcctccagaccaggtccatcttctccctttttctctagcatggccttgcctttcacagcctgagcctatgctggctgggtacttagcaccttgctttcttcctgtttgagctggccaagcccagggttgccttttgttattctgctgctagaagttagaacattgaagaattgagggtacacctataaacagactggcagatgatatagtgcttaatgtcttgcctcagtttgtcattgtgtcagaacatccgaaaaaagataggagaaaagttggagtttagggcataattttcctgtaataatttggagctcaaaaatattacnatgagaaaataaaaagctattaattagcaggagactaatcacatgaagaattcaattagatatttcttctacgtgnatagttataact

SEQ ID NO: 689 - DNA, 1067 bp, Homo sapiens
  misc_feature: Incyte ID No: 406289.1
  unsure 17, 35, 40, 70, 496: a, t, c, g, or other
gtgtgattatgcatatntgcatctgaattaatttngactnataataataattaaaactttaagatttgtntttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcccttggccccagacctgcagagaacttttgcattctcttttgaggcctcacctgtatgtagttccctcttctccagtaccttattctataaactcccaacatgttagcactgtaagactctcagctttagtgacagtgacattgcctcatttctgggaggtctctacctctctccgtgtggtcaagaaancgcccattgggcaggaaaacagaagtgtgtgtgagatttgcctcctgtgttttcctgttctcaaatatcacagtcctgttctgcctgtgttccaatccctgaaaacagttttctcaaatattctatccagcttcagtcgttggtcatggtgggagggcaagtccatcttggctggaagaggaagtccttctgcgtctttttctccttgtccttccaccttcttttgcattgtggattttctaaacttgccatataagtaagcatgtgcctatttgtgaagggaaagaaaaaacccttttaattttttgaagctgttctgttggttcctcacaaggatctgaagggattggtaaataggatgaaagaaattctgtctttcacatggagaataccgtgtgtgacattaataaaaatgagcatgtctgtaagcaaagagtttcactgagctctgctagaatcagaagcaactgaacttacatcgtagtttgcaaaacacagatttgatttacccaggaactaaagctgagtaagctatgggttaatagaaggtctgtgaagggtacttagacta

SEQ ID NO: 690 - DNA, 6609 bp, Homo sapiens
  misc_feature: Incyte ID No: 175918.15
  unsure 825: a, t, c, g, or other
cggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatnccatctctgccaccaatgccatccattcccccaattccagttcctcctgccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggaccccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagataacttgatttgaagtccttttcatatggactaattgtagtatccaatttcctcctgtccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaagg

SEQ ID NO: 691 - DNA, 2771 bp, Homo sapiens
  misc_feature: Incyte ID No: 1068290.1
  unsure 1624: a, t, c, g, or other
gaagacgacgtagcagccatcttttccctggctttggtgattcagaaactcccgttctgtggcgaaattctccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaagttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaatgaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagataatacatactggggagaagccgtacaaatgtgaaatatgtggtaagagcttctgccttaggtcaagtcttaataggcattgcatggtccacacaggaaagaaaccaaacagcactggggaatatggnaaaggcttcattcgtaggctggatttgtgtaagcatcagacgatccacacaggagaaaaaccatataattgtaaagaatgtggtaaaggcttcagacggtccttcaagtcttcaggcccatcagggagttcacactggagagaagtcatacaaatgtactgtatgtgggaaaggctacattactaagtcaggtcttcaagcccatcagagagcccacacaggagagagaccttataactgtgatgactgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtggagaaaatccatccaaatgtgaagactgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 692 - DNA, 460 bp, Homo sapiens
  misc_feature: Incyte ID No: 094873.1
caaagccctgaaccccagctgcagctttctgagcttgttctgtccatctgtgaagtaaggcaatgagaagtgagtcggggaacggaacccacgatgcgtcagaggagtgttccagttgcacacacactccccagccacctggcagctcagtctataatctggaggcttccacatctacagctccatacaaatgaacctctggttctaaagaagtttcttccttgtctggttctcactttctaaacctcagtctctggagagaaaaggagtcctggaggatgaacaaggcgagcttggagtaatttggaaaagctaatgttgtaggacagaagcaaagcctgcaagtcacagcctaggttccctgagtgatgttttcagcagtaaactgcaacttcaaagctaagagccatcctaataatttgccataaaaggtagcttgttaaaaatgagtcaaaaaggc

SEQ ID NO: 693 - DNA, 985 bp, Homo sapiens
  misc_feature: Incyte ID No: 403616.1
gacatgctaattccacatgggcagagccaatgccaaggcattggtgtagtgttactgggaagagaaagaaaagccatattctcacagtagcagggaagtggtcaaaacagtcaggtgtgtagttgatggatgagcagattttcccagaatttcagaggtaaagaagatcacattgtgtttctattttgttttaatgaaatttttttccttttgttgatgctgttggtgtttccatggttattatcaaaagcagtttctggttttgctgaaaggctagaaatgacaactattttcagagtttctaggtcttgaaacatcagtcaacctttcaaagccagcattgatcaagaaggaaagaggtttttctaatgaggaaaataaaatagtaaatgatactttgacattccattagttgtaggaatgtgtgccccaactgactaccttgctttgctctctctctttccctctcttttctaagttttgctaataataaaacttaggaagtacacatttaggaaactgtctgtccttgtgactgatggcatttatacataaaggccacccggggtgtatggggggaggttcatgaatgcagtttttcttttcttttttctgtgtatatgattccgtatcaaattttaacttctagatgtttatttttttaactgcagtcaaggcacaaaccagtgtaaatcagctgcacaaatgtttgtcataataaatttttattaggttttatattggaagccatttagaaactagtcttataatcactcataaaacattagctatcttattgttttacaagagtatgtagagtatagtaatttcttagtaacatcccaaatccgtctttctccaaacacaatacagcaaagctgtgttttctgtgattcagtaagtcagattgcattttgagtattcatgtagttttccccacccccctgaatcaggaattttcttcccccattattattgttttctt

SEQ ID NO: 694 - DNA, 618 bp, Homo sapiens
  misc_feature: Incyte ID No: 095088.1
gcttcaacatacgaattttcagatcatgacatctacatatgtatgactgtatcagtcaatgtctagtcaggaaaacagaaaccactggagataattcaaacagagaggaatttcatgcacagttagttataaaagtgtaggaaagactggtggaacaaaatgcagaagttacctagggatcagaaagccgctaccatggctgggttgggagcccacaagcctgcactttctgcttccactgctcgagctgaaaccacatttccgctgctgaccagaaacctaggagcccacacccccactgattctactgaaactgcctattatgctttcaactggaaggggttgaatttttagattaagttagggaaaattcactcttttttctggtattgactcttctatccattatcatgggttatctctctccatttacttaggtcatcattaatatcttttaatgaagtataattttttccataaaggttgtacatgttttttgttatattcttatatgtaaatttccattataattagaaatgagaagtttctaataattatattttgtgactgtatattgctggcataaaatacattgattttatatgttgattttgtatc

SEQ ID NO: 695 - DNA, 489 bp, Homo sapiens
  misc_feature: Incyte ID No: 230402.1
cagtagtaggaaaaaaatatactacatgagggatcattgcagtagagaaaaacactttttagttatcttctgcccataatgtacccataaagtgtacccataatgacagaacaatttgggcaaatgtgcttgtactccaggagtcctgaaggcatagttcaatgtgaccctttgagaaatctatgattctttgcagtcttcatttttatcttaagaattcatgcagattttgcatctgctactccataatgtttattttagtataaaaatatttaaatttttaaaattaacatcacttatccccactgctgtataccttgatttggaaagtaaggtggtatgcacaatcacattgaattcatagtaagtgctgagcagattggtatcttatgtttgtcgaatgtttgagttgcacacacaaattaggcttctagaacctatacaggaaaatcatcacttggtcttggacattaaaaaaaaaaacaaaag

SEQ ID NO: 696 - DNA, 802 bp, Homo sapiens
  misc_feature: Incyte ID No: 095172.1
  unsure 431, 469, 538, 596, 678: a, t, c, g, or other
gtcttttattgttgatttctcatttggttaggtcggcagcacagatcatggtctatatggttggttcttaatatgtattgagacttcttttatagagtattattttggaaatactccatgagtacctgaaaaaatatctattattttgtcatattttcccccaaaggtaggcatgtcagtggtgataagcaaatatctctaaaaactttgtaatagtaatttttaatgtttgctttagtattatagtgcatttctactagaattagtatggtaattctctctaaaggcttaaactttgctgtctcattttaccttttttacccccaggttaaccaaatattctttaggccatcatcatttgtcagtgaaatggtggattgggtggagagggatatgaagcatacttacacatgcatttctttatataccanttgccagccccagaagtgtgagccagactttgttattnacatatatattaaaaatcacatgggaggagttacgaatgtaggtaaaatcccaaatttagcactgaaantaccctctcctagataagcaacttactatatgaatatgtggaatattaatgttgcatnttgtatacactcagggttctatcttaataaaagatattaaatttaaatttgtcaactgatttgtaacaggtttaaagatctncattatcatcaatggtgattaattttgggtcacaaagaagcttactttaaaatttaaaaacatattgaaatacacttcttctataaaataattgaacatcattagtacgtagtgtacagttagc

SEQ ID NO: 697 - DNA, 448 bp, Homo sapiens
  misc_feature: Incyte ID No: 250091.1
ggttttatagatgaggaaattgaaattcagtgtttaaatgattcccccttagtatttgcttctatagaaatttttacctgttttcactctggtttctcttcagatcgtgtaaatctttcgccttttactaaagaaatttttacctattttcagcagttttctcagtgtattgtaattatttcatcaaaagttgaatctccttaccaaacttgggtactactgaaaggcagaaatttctgttattcatcattattcctccagagcttggcatttttttttatgctcaatacattgagtgaaggaatgagcaaacaattaaaagaaagtatgacaaaaaaatcgtaagtgagatccagtctctgcccaaatgcctgagaggcaaaatagcaacatgattggtgctgggactccagagccaggcttcttaccagcttgacttcatactgtc

SEQ ID NO: 698 - DNA, 2188 bp, Homo sapiens
  misc_feature: Incyte ID No: 4113161CB1
cggacgcgtgggtgcttagcaacggggggaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttaaaaaaaaaaaaaaa

SEQ ID NO: 699 - protein, 544 aa, Homo sapiens
  misc_feature: Incyte ID No: 4113161CD1
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 700 - DNA, 902 bp, Homo sapiens
  misc_feature: Incyte ID No: 335375.3
  unsure 8: a, t, c, g, or other
gggcgcantcaggagggcgccggacctgggaagccgattccaatcagttgtcagacccgggaagcccgacgttccgctctcccgagtccctctgtggggtgaggaatgggtcttgtgaaattctgagcaaaaacaaaggcaaactctatctccgaaagggacgtttgggtcacatttcctctctgggggcggactccaaagttctcaaaatgagaaggcagaaatgaaaacacttcaactttttttttcttttcttcccggggcgggtgtcttgaacccctcttctccccgcccctctggctccgttctcctcccctcctccacccgtctcccggactcgggggtggcgcctgacaccccgacactctcggacactgtttgggtaaggggtggggggcgggcacggcggactacatttcccatcatgcctagcactgcggtcctcactaaacaaaaaaggaagtcaattccttcacctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacaa

SEQ ID NO: 701 - DNA, 570 bp, Homo sapiens
  misc_feature: Incyte ID No: 095395.1
gcatacctgcacaattcagcctgacctgccctcacccagacaacagaaggaacaatgaagactttagttgtctgagccagaacacttctcagataactgtgctgcttacaaattgcttcacatacacaatctcctctgaaattctcaaccctgaatgctgggagacattgcccccaattttcagatgagtagactgaggctaacagaggtaaagtggcttgttcaaaactgcactactagtaactggcagctccagggtgaggtctggctcctggcccaggactctcactgagcaagggctcggtcggcccacccaggaccaaagacactgcagaccatggcagcaggcacttggtgttctgtagtctgtgaggggagagcagagagcagaacctggtgtgtgggacaccctctccttcaccggtgttcctgcagggaccctccgtctcctgtaaagggggaagccctaggctgactcccagcaagcaagtcctctctcacctttcacctgaagcgatgaagcatcttaaagtttgcctaaagcagaagtctacaggagacccacagaat

SEQ ID NO: 702 - DNA, 1331 bp, Homo sapiens
  misc_feature: Incyte ID No: 229514.1
  unsure 995, 997, 1001-1002, 1005-1006: a, t, c, g, or other
cccaactcaacttcccatgctgagagtaaaccaattttgcttttgctcaggaaaactcttttctttctaatcaaagaagatttgtcagattttcaaatgccatctgtaatagttttataaatgacggtaaggggatagaaaatgttggtcagataaatattttatttagggttgtatttctcttcttttctcctttatctttcttcttaggttcgttctgctcttaagctgagaacataggagtctctgggaaggatagagaggggaaaacaagataacctaaaacaaaagtttttatttaactaatgaatttaaaatgtctgaaaactttatcaaattccaaagcagactgcagagaaagcaaaactttagaaaataaatgttaaatttaaaattaagcatagagtggtaacatttatagtctttaataatatacattttatagtgctttttagtttataaaacagtttccacttatacacaggcatttatgtcaaataccagaagcaggaatccagctaatatcttctgaggtagtttgtttcagtataactctgctacctcccttatagggagattgactggtttttcagctcctaaaaggtgaaaaataaagcacacatacacttctacttaatattttttataagtaatcctaaacattaaaaaacatataaattacatatatgtgccgtgtgtgtgtgaatgtgtaaatttaaaaataatggtatcgatgccatctgaaacttcatagagcagaacttaaccatctccccagaaatctttcctggactaattttagacattactgctaagactgctgttatagcaaacctatttacttgatttgagatttgcattggggaaggcagtagatacataagttgctaacactttcttgttggtcagggatactcaatttattgggcaaatcatgacgtaatatctcctgtttagggttatctcacagaaaatcagcacagaaagcagcatgntngttnnttnntagatttcttcatacttagggacaaatccagcagatctcgtactggttaggaaaactatacttaattttcttatataattgactctaaatgtttgtgatgactccaaaggagtggaaaatactttccatgaaatagttcactctagaaaactgaaaaagaaaatttttgttgaaaatttaaagagatttatcagaataacttatctcatagtatgaaaagtctttgctttttattttccttaatttttttcctgaagtcatatttattgatgctcattgggaacttttgcccatacattatcttcccggatatgcccaaaggatt

SEQ ID NO: 703 - DNA, 298 bp, Homo sapiens
  misc_feature: Incyte ID No: 095573.1
ggactgttgagtcagttaaacaatgctgtgaattctttgcattgagtacttacatgtgaaatgttagaatttagaatttataacattatcaagagcatataattgttcatcgagtgtgctaagtaatatgtgaaaacaaaacttgaatttttagctcttgttctggttgcaagtgtttaagctatttgttgtcccctaatgataatggtagtaatgttaatgtagtagtaatatttcctcttgtttctggtaagttatttttcctcaccctaaactcctgatttaaagtctctgttaa

SEQ ID NO: 704 - DNA, 1215 bp, Homo sapiens
  misc_feature: Incyte ID No: 230463.1
ggccaacagtaaatattcagctctcctcaaaggaaaaatataaataatgctgatagaaagctcaaatttgatttttttattatgattatttcagctcttatggtatttaagtgtcttttatgaaatgttgattgtagtagcttggcaaaatagtaaggtggcagcccaatgttgatccctacttttttttttcactgctccatggaatttaaaagtctgggaaccactaagccaacatcctatctaaagttctgagacttattaaggtattaaagtaacagttttattttgagatttagcttgtgttatatggaatttttcattagcacaatgtgttgaggtgagacttcatggaaagttactgtaaaaaacaaaaaaaagtccttacttccattcagtttaccatcatggatccaaactaagggtaaagccaatacatcctaatatgtgcccaacccataactttaaatgattaaatgaaacacacaacagggagatctattgttaatgtgttaaccaaaattgccaggaattgccctaaaggggaaaaattgtttaatcagtaaatcagtgaggaaatacaagattataaattagaagtgttgctatggtgttagctcttacatccctgaacaacaaaaaagacagttcaaccccaagcatggaacagaaaaatgctgagcttagaatgttgtcagctagatattgtgtaaaatagatgttctctttaatacctgtgtctctgtggataatgtatttctagttcttccatcctgtcccttacagataaccagaagtcaattcatgttaatattttgttctttaattgtgacatcgttttcatttgtaaatatgcagcattatgtagattcccagctttttcatttaaaataatttcgagcattgcccacctgcctgaatgctcattactgggaggtaaataatttttctgctggtgatactgcctgccaacaatttcataagcagtggtttatctaactcattatacaagatcgacatgagatacagacgagagattatgtctcttatggctttatcatcaattaaacttagcaaagtctgttaaatttatttcagagtctcccagctgtgaaaagtagagttccacttatgtcatccatatctgcacagtaatcttttttttaatcctaaactttcttaacaggtttcttctccttattctagacaataatg

SEQ ID NO: 705 - DNA, 360 bp, Homo sapiens
  misc_feature: Incyte ID No: 095702.1
cccacgcgtccgcttagctgacccaggatctgcacatagttaactctgaggctttgttggaatccgccaaagattcattgttaaagacagggaaagcacaactcatttccatttattttagttcaacatttatgccagctctgcgctaggtgctgggatataacaatgaataagacatggtcttggacttaacggtgctcctaacctggcagggaagacagatgtaaattgctaattattgtacattgtactgagtgtcataatacagtgtaaaatgctccagtttatgaattagaggaactatgctttcagccttttattctgagaaatgtgccatttaataataaagaactgggatac

SEQ ID NO: 706 - DNA, 1597 bp, Homo sapiens
  misc_feature: Incyte ID No: 218090.9
caccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtaaaaaaaaa

SEQ ID NO: 707 - DNA, 282 bp, Homo sapiens
  misc_feature: Incyte ID No: 096126.1
  unsure 197, 213, 246, 259: a, t, c, g, or other
ctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggnacagcagcagtgctgnttgtgggggaccctcctgctccagaccagctgncctccctggagcncgaaggctagattgtctgagtct

SEQ ID NO: 708 - DNA, 3282 bp, Homo sapiens
  misc_feature: Incyte ID No: 1508254CB1
  unsure 3130: a, t, c, g, or other
ccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctccntaaaacatgaaatgatctcccttagtaatccccttgccaaattcatgtccctgtaaactctacaggatggggacactattgaggtacggtttcctcactttgggcctgaacatgcattctcaagtggggtgatcccccacaataatgtttta

SEQ ID NO: 709 - protein, 917 aa, Homo sapiens
  misc_feature: Incyte ID No: 1508254CD1
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 710 - DNA, 1594 bp, Homo sapiens
  misc_feature: Incyte ID No: 207452CB1
cggctcgagcggctcgagcggctcgaggcggagagcgcggagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggatgcaggacgtggtctatggtgagccaacgacacagtgagaaggagcaggaagttgctgtttctcctctgaccagcccacactgcaaaggaaacagacgccatcctacacctatcagccctgcctgccaggagaacagagcacactcctggtctggatggggctgctgcttgagtgcagagggctgcggtaggccctttgcaggagtcaggtccctacacttggcctgtttgtgcaacctatttaatagacgattaaagcctaga

SEQ ID NO: 711 - protein, 320 aa, Homo sapiens
  misc_feature: Incyte ID No: 207452CD1
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 712 - DNA, 272 bp, Homo sapiens
  misc_feature: Incyte ID No: 290233.1
  unsure 5-7, 46, 56-219, 242, 252, 254-255, 270: a, t, c, g, or other
tgacnnngcagttgagggtttgctgtgtatcacatttctgtatttnatcacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgcctttcttacatgatncaggcccagnanncaaactcggcatgtntc

SEQ ID NO: 713 - DNA, 506 bp, Homo sapiens
  misc_feature: Incyte ID No: 1096917.11
  unsure 24, 385, 430: a, t, c, g, or other
ttcacgtcacagtgattggaaganatttgacggtgtagtgtcttcaagcttgctttttgtgtggggattggggagctgtcggggcggctgccatttggtagctgttgagggagttgagagggagcgtattgtgcggatgaaagcgggacgcttcgaggcagacgaaggaacatctgttaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacnagttagaggtcacaactgcccgaagccagttctaaatttttatgnagccaatttccctgcaaatgtcatggatgttattgcaagacagaatttcactggaacccactgctattcaagctca

SEQ ID NO: 714 - DNA, 2491 bp, Homo sapiens
  misc_feature: Incyte ID No: 208748.4
caaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggtgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagccaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataattaaaaaaaaaaaaaaggg

SEQ ID NO: 715 - DNA, 6422 bp, Homo sapiens
  misc_feature: Incyte ID No: 407517.2
  unsure 203, 2134, 2161, 2189, 2271, 2280, 6386, 6413: a, t, c, g, or other
caggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcangagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctcccaagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagattgtactgcacagtggtaagccaggctacagttaaaattacttgactatctcaatcacgattggaaaagtgaatatcacataaagcctaatcagcaagacattagttttgtcagtttaacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgcaagcatccacctaattataaaaagccagttctcttttcttttcagccaaatcacttttttaataacaataaggntcaacttatggtaactgatagtgagtngtccaatcagttttcaattgatactgtnggtagtcatggagctgttaaatgtaaaggcctgaaaatggactatcaagttggtgtcactatagacctgagcagttttaacnttactaganttgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagcttatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatcaaaccacaagtttaaaantcacatgaaagtgtgtttccatgtggncctttgttt

SEQ ID NO: 716 - DNA, 3787 bp, Homo sapiens
  misc_feature: Incyte ID No: 233997.1
cagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgcttctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgcggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatatacc

SEQ ID NO: 717 - DNA, 844 bp, Homo sapiens
  misc_feature: Incyte ID No: 237067.1
cacctgaaatcttgaataggttttctatttcaagtcaagagctgaggttttccccttctgttttacccttgctcaaatgtcttaatgcagttctttcccaagctttccctgcttccttaacaacgcataggatgacattaaaagttttaaatctcatccctgcctgagaggttagcttcctacatataagctccttttgtattggacttgtaattgctcattcagtgttagtattgccctgtagagtgtaagctccttgagggccaagaatgcttctgcctcttccattgttgcttccccagtaccttctgtatatttcataaccaaataatgaaaaagatacattccatttaaagggcattgactttgggttaaatgattgttatattgttttaggattatctatgatacactttgacatctcacacacacacatgaacttttctttttacaatgcaaaagtttaaacaatagcttaaatttagactgcaagaatattataatctcaatatggtatttggtactagagatagatttcttttataaaatcttaaaaacaggacgttctcttccttttgaacctttatcccagaggtgaaaatatccaatatgttgttttctgcatatattgaagtagtagtttcactttaataaagatggattaaaagttgtgagcattctgtgatataccagttcaacacaattctaatacacatgaaatggaaatgtccatagcttactgaatccataaaatgtcagtactgcaccatgaatatgaaagattgtttaaaacaaaataaagcctggcagtatcaccaacaccataatgacaagccagtcccac

SEQ ID NO: 718 - DNA, 1153 bp, Homo sapiens
  misc_feature: Incyte ID No: 330862.6
  unsure 161: a, t, c, g, or other
cttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcntttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcattatctttgtaaataaagttatgatgtttctacacccattaaaaagttcttaagaattttattttaaaataagatattcacatttataattttaatatttccaatttctcagatggtttctactctgtataaggatatgagagtaatgtctccctacacttagtgaatggttgacagtcccaacaccccacccctttcttaaat

SEQ ID NO: 719 - DNA, 1797 bp, Homo sapiens
  misc_feature: Incyte ID No: 330862.8
cccacgcgtccgagcatccctccttcccaggacacactcaaagcgacagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatgggccatttgtcaattcttccttcaaggccggtgccgctttggagatcggtgctggaacgaacatcccggtgctaggggtgcaggaggaggacggcagcaaccgtagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccataaaa

SEQ ID NO: 720 - DNA, 1894 bp, Homo sapiens
  misc_feature: Incyte ID No: 2124957CB1
ggcgctgtcgtgtacccttaacaggtatctgctcctcatggcgcaggagcatctggagcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttct

SEQ ID NO: 721 - protein, 463 aa, Homo sapiens
  misc_feature: Incyte ID No: 2124957CD1
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKVKKFENRDQYSHLLSDHFLPYQGHNSFREKYFSGVTKRIAKEEKSTQE

SEQ ID NO: 722 - DNA, 3665 bp, Homo sapiens
  misc_feature: Incyte ID No: 1098722.6
aaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttcccccccccccccttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagactttttaaaagcccaatttacagccgtatattttcttatggatgtaatttatgaaaaagatgtctgtacta

SEQ ID NO: 723 - DNA, 580 bp, Homo sapiens
  misc_feature: Incyte ID No: 1099023.1
  unsure 13, 36, 53, 110-111, 136: a, t, c, g, or other
gatatctaggctncggtagagtaagagagtgaatanggtgaaattagagaggntggagtataatatattttgaagggattgtcaatgaggtgaaaattgagtattgggtnnacagatacatttgagctaaatatgntggtgtaggtgaactctaaaataatctgtagcagtatgttctgatgaacataatctctagaaagaatactacagatcttcaagcataagatagaactgtatgtattgacctggaaagccatgataaatatgaggaaacaaatctgaaagaataaattccaaattgttagcagtgtttactaggaggagatttgggagcactctgcctatagtctccagaaaaccagcaaacaagttcctgccaaaagctatataatttctcgaagtttaattaggttttaattaaatatacttaaatctttgtaatcatttctctacctgaagaattactgtatcacttctcagccttttggctaagatcaagtgtagtatctgttttttcagtttaatatctgatatgtcctaaattaaaaataataaaaaataaataaaggggagataagag

SEQ ID NO: 724 - DNA, 6384 bp, Homo sapiens
  misc_feature: Incyte ID No: 201395.4
ggagcggagagggcgggagcggcgggggcgcgcgccggcgcggggccagcctcgcttcgccaggtcgctggcggacgcgcgccgaagtccgagcctcagacgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcaaagaatgaagttcacttagaaatcaaagatgctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaacctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgactttt

SEQ ID NO: 725 - DNA, 8146 bp, Homo sapiens
  misc_feature: Incyte ID No: 4295277CB1
  unsure 8083: a, t, c, g, or other
gccgcgcactctccgcggcgctgggagagggcggagggggaggcggcgcgcggcgccagaggaggggggacgcagggggcggagcggagacagtaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggcgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggtgagagagagagaaagtatgaggaaaggaaaggtattgcaagaggaaggagatgttaatgacagagggttctaggtggagataccccagagaggaataagggtagagcagggtggggtttaggnatgagcaaatatagccctacatatagggtttgctatttttttaggcagtagggcttttttttg

SEQ ID NO: 726 - protein, 2468 aa, Homo sapiens
  misc_feature: Incyte ID No: 4295277CD1
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 727 - DNA, 445 bp, Homo sapiens
  misc_feature: Incyte ID No: 098533.1
  unsure 406, 413: a, t, c, g, or other
ggcaaggccagtggctccgccgctgggtccgctgccctttactttcagtcagcctggggcggtgtcctctcctacagaagtcctgagcggccttccacgtggccggccctcgagtccgtccgccccgacccttcgtagtcccgaaaccgcccccctggctaaggtctctttcccccaggctgcttcctttctccttgcttttttcccaccttttttgttactgaccaaggtgaatcctttccttaacaaatcggcttaaagcaagctaactcagttacaatacagtagaactgtacttaaaaaaaaaagaaacgtgaatctaaccgttacgtcagaaaaaaaaatcttaaattagacgaatttcaaacagtgcttaacacatcgcagagcatttgcagttatttgnatcacgncttttgaaacacctttatgctgtaaatagagc

SEQ ID NO: 728 - DNA, 962 bp, Homo sapiens
  misc_feature: Incyte ID No: 983684.1
ggaaggaaggagctttgtgttttagagggaaaaggtaagatttaaaaaaaatcccttgggaacaagaggacaagcatctgagtcatagattggggtgtggaatgatcggggaggaagctcacctctccctcagagttctaaggaaagagttgaacaatggcaggagggacagataccacagaactgatgagcttggtagaaaataagctcctatggtagcttttgctgtaaaggaggaatcattgaatttttttgttggctaattttataattttttcaaaatgtatactgcaggacctgagttgttcagcattgtataatatttaaaatctagagaacatgaaaaaagggaagaaaacaaacctattttaaagcttacgtgactactttttaatgagttcaggacaaaagatgatgaaagttattgggtattcccatggaaaaagagaatagagatggtaaaacttccttttcttaggaaggttaccttctaggaagccacagagttgccatccttcttactgtccagagggaaaattctagagttttctgaatttgcacctcttttgtctttgaagcagaacaaattaagtttcaactgacccaagtcctaaggatactaccaacctgcttatttaaaatagttgcaaaccatgaatttaaacacttccataaagcctaattcatctccaccaattcacaaaaaaatgccaagaaagcatttaccacatgcaatcactgttccaaagatttagagaggtttagaagagtgattgtaaccacaggctttggcgccatattgcctggtgcaaatgtggctttggtgcatactaatcacagaattttagtctagttactggctgtgctatctgtgcctcagtctccttatttgtaaaatgggaatgagcataagaagaataagtgggttgaaagtctacattgcctagaacaacccagcaaac

SEQ ID NO: 729 - DNA, 523 bp, Homo sapiens
  misc_feature: Incyte ID No: 983684.2
aaatactgggaatggggcaattcctgtggcagttttgttttccaataattgttttttcttatatcggggatgacaaatgcttgtcacaaagagtagccttgttgattacacttataaatcttcgggagacttcttcaatgagtcagtgttagagctttcagtttccataaatgcagatttcctttactcagtttttttttaaacatgagctgatctttcttagtttgcactataataccctccactgaagtctcactgcaactgcttttaatcatatgtgaagagaaactagccctttgctaaaatagttgcatgtttcacgggccagtgagtcatttagtcatacacttaagaactttccacctttcaagtgtttatcatcacctcggatttcacggcctaatgccagtcaatttcatggggcatagaagccctgtacgtattagtttgggccattattgtatcagtcttgtttattcccagaaaagtcttatcaagaaaagagggagtgactataatcaga

SEQ ID NO: 730 - DNA, 1489 bp, Homo sapiens
  misc_feature: Incyte ID No: 1837317CB1
ttctagatcgcgagcggccgcccgcgatctagaactagcgcgtccgccccgcgagcacagagcctcgcctttgccgatccgccgcccgtccacacccgccgccagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacat

SEQ ID NO: 731 - protein, 375 aa, Homo sapiens
  misc_feature: Incyte ID No: 1837317CD1
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 732 - DNA, 2210 bp, Homo sapiens
  misc_feature: Incyte ID No: 2937262CB1
gtccgaagccgcagtacttgaccctgtattttgggagtcgaacggatcaagcaccacataccgacagaccgcatgtatgacagtggtcccataagattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacattaaaaaaaaaaaagacaaatagaaaaagccccatgaggaaaagggaaaaataaggagggaggtgtgggagaagttgtgatgacaacgggaatggcggctg

SEQ ID NO: 733 - protein, 582 aa, Homo sapiens
  misc_feature: Incyte ID No: 2937262CD1
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 734 - DNA, 6828 bp, Homo sapiens
  misc_feature: Incyte ID No: 199290.9
ctcccggaagctgcgacactacgccctgcgctagtcccgggacgtggggttttatatccggattcttagcgcggactcagaacccagctcttccctacgcggtcggcacatgcgcggcagctcttttccttcttcctccacttcccctaccctccaccgtccgggagccgccgccaccgccgccgaggagtcaggaagttcaagatggccgccgcgggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatattttattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcaaaaaaa

SEQ ID NO: 735 - DNA, 5467 bp, Homo sapiens
  misc_feature: Incyte ID No: 3151579CB1
acgtctccgccggagcatccgggccgggcggcctccggggctgccagagcagcagggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggccaagacgagaaaggagccgaaagcgcaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgtatagccaagctggattcagagtctcacttccctgtcccatccagtaagagcttgactattccgcagaaatggtatttcatctgtacctttggccttgtacacggttactaggatagccatcccaccataggatgtgtacatagatactgaatatcataatccaatctttgttcttcattagacctattttagggaaaaattcccgctttttttcccaggtgggtttgaagtgggaaattctccggttatggaaattccgccctccccgggaaataccttttaacctcttggagccaaattttttcattaccccaaaattcaggccatttttcctcccgctttggaaaaaaaggggcgaattttcttt

SEQ ID NO: 736 - protein, 1530 aa, Homo sapiens
  misc_feature: Incyte ID No: 3151579CD1
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGQDEKGAESAGQLFQPCHAHQDPGLPSSRLAAGGAAETTARREQGAPQEPEQLPPAAQAGDGQPAAPDGGARPDGARVSVLVDAAGASHCQPCAPGGSRRPTRRPTETQSEQGFQRRAGRVTAVDSPPCAAAPEGSYQCYLFDCVVDVFLRHEI

SEQ ID NO: 737 - DNA, 454 bp, Homo sapiens
  misc_feature: Incyte ID No: 235056.14
gtcgggtctgcgtggatcggtccttccaggacaccgtcgccttcccggccgcgtcggagtccggcggcgacctgcctctgaaacatggcaggctcggatgctggtgagtgtctccctggggtcccagtatgtgtggactgaaaccgtccacctccagggaggcctcgggctagcccggactgggtctgggctgtcggcggggctcgtgaccttcagacgccgcgtcgcgctggcgggttccctggatagggtctctcagcttcaccacctcttcgcttcgaggccgtggaacagcagtatgctgtgggagagagagaggcactggggcgaggccggtaggacacttgggtcctggctgtaaaaagagcggtcagaagggtcgtccccggacttgtctttctgtggggcgtctagccgctgtccgtgtgccctccgcccttgcactatgggccct

SEQ ID NO: 738 - DNA, 355 bp, Homo sapiens
  misc_feature: Incyte ID No: 337939.2
ggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaaggtaacgccctggcgcaggccccctccagtgctgagccgaaggccgaaaggggacaccaggcctcccacggccaggctttctttacggcttcgtcactcacctccttctagaaccttaaggcttctagagccctcaactccctagagccagctttccatcctctcactcagggcccctttcatccctggagtcccacatcttcttttgcttga

SEQ ID NO: 739 - DNA, 2969 bp, Homo sapiens
  misc_feature: Incyte ID No: 208379.1
  unsure 2001: a, t, c, g, or other
aattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcattggtaaactagctccctaggtgagacagcattcaatgccctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcagggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctggntaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacactgaagtacaagatgactactgtttttaatacattttctcactatattatatatttattgtagtaaacttagaaaccatatgcatcttgaatgttcctga

SEQ ID NO: 740 - DNA, 795 bp, Homo sapiens
  misc_feature: Incyte ID No: 251631.6
  unsure 228, 261, 265: a, t, c, g, or other
gtctatcatcacagaaaattctattgcattgcactgggataggtactttttgtgcccttgggctgataagttcaagtgcacttaactagcttcctccaagtggaatcagaggataaatttaccatacaaaatacaggatacccaattatatttgaatttcaaacaggcaacaaataattgcttaagtatgcccctcactgcacacccaaatattacatgagacattcnatacatatatatatatatatatatatatatatntganattcagatttaactggacatttggtatttttaatgtgccaaatctagcaaccctatctgaagagcaaaactggagtgtctagtctggataggtccttttacaccacagggagttatttgaggaattgagaagggctgtggtacctgtaaagaactaactcattatgaagaaaaggatctgtaagtttttctgtatgtgtaaggaaggccaagaaggtggtttccagatatatttactttttcttctctctctcttaggttgcaaaagcttctcatttcagagagatgccaggatcctaagtgcctgccaaacttaccaattctaaggaataagtggatggatggcattactgagtcctacattactgattgattctgcatccgcaaattgttttattaaaaacattctacatcatgtgtggggagataaggaggataaaatgaagagaaagaatattattgaggggaagtcttctgaatacaaaatgtgttaattttttaaataagtacacattcacaggttcaaactat

SEQ ID NO: 741 - DNA, 1054 bp, Homo sapiens
  misc_feature: Incyte ID No: 2847188CB1
gcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttactaatgaaaaaaccaaaagg

SEQ ID NO: 742 - protein, 127 aa, Homo sapiens
  misc_feature: Incyte ID No: 2847188CD1
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 743 - DNA, 363 bp, Homo sapiens
  misc_feature: Incyte ID No: 100579.1
tatgaaaagttggtaatttctgaggtcttaacatgatttatttaaattatttttagagtaatattaattctatggctcagtttatttaacatccatccagagcaaaatgggttcttcaagtaatataagtatataaaaggaatattaacctcatccctgcccttgggtgcagtataatctagagtaagaaatagcatgacattcgtcatttaattttttcatttttaatgtactttttaaaaaccgcatggtttaatatagaattagaataggtggttaactttctctgtgtttcgtatgtatagcttatgtgatcgcaaattattaatgaaaaagcaaacggagtcaaaaaaaaaaacaaag

SEQ ID NO: 744 - DNA, 611 bp, Homo sapiens
  misc_feature: Incyte ID No: 1327498.1
aatttggatgcaggcacagagagaagactatatgaagagacacacaggaacaatactactggcgtgattccatcctgtatggctgttctcttgagcagtggtcgtttatctccgtctgctttctctcccacctaagtgtgtgccgccacctgatggaagattcgatggacatggacgtgagccccctgaggcccagaactatcttttcagttgtgaactaaaggccgacaaagatgatcactttaaggtggataatgatgaaaatgagcaccagttatccttaagaacggtcagtttaggggctggtgcaaaggatgaactgcacattgttgaagcagaggcaatgaattatgaaggcagtccaattaaataacactggcacctttgaaaatgtctgtacagccaacagtttcccttggggtctttgaaataacaccaccagtgcttttatggttgaagtgtggttcagggccagtgcatattagtggacagcatttagtagctgtggaggaagatgcagagtcagaagatgaagaggaggaggatgtgaaactcgtaaggatatctggaaagtgatctgtccctggaggtggtagcaagattccagagaa

SEQ ID NO: 745 - DNA, 670 bp, Homo sapiens
  misc_feature: Incyte ID No: 1330212.14
ctcgagccgcatcggctcgagcggctcgagcggctcgagggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaaaaaagg

SEQ ID NO: 746 - DNA, 597 bp, Homo sapiens
  misc_feature: Incyte ID No: 252471.7
gctcgaggccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcactt

SEQ ID NO: 747 - DNA, 1357 bp, Homo sapiens
  misc_feature: Incyte ID No: 252471.4
aggatgggaagggcgaggttggcccctggtgccccgggagaggggacagggcggatgtgcctggggtggaggtcctttgaaggtgtggcttcggaccgagagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaatgcat

SEQ ID NO: 748 - DNA, 371 bp, Homo sapiens
  misc_feature: Incyte ID No: 983536.1
cgcagctaaagtcatgtggaaggtagaaagacgccacagccgcctttcgacaactttttgttacaaaagtggagatctacacggaggcgacggcctaggtcgctctgacaggacccaacgaccctcctgacgcgtccacccgtcctcgctagcagggtcccccagcgggctctcgacctgcgccaccagagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaatggaaaccaaaatcatgggtattttga

SEQ ID NO: 749 - DNA, 366 bp, Homo sapiens
  misc_feature: Incyte ID No: 983536.2
  unsure 111, 160, 164, 175: a, t, c, g, or other
acaaagagagaacattcctaaacgtgcatgcgccaaacaatgatgctgcaaaaaaatgagaatcaaaaactgacagaagtgaaagaagaagtcatcaaatcagcacttatngtttgatacttcaacaaccttctcacaacaatggttagaaagctagatncatngtcatcaagcntacagaattcaacagtgctattaaccaacaagaaacaagatctgaaaacttttttagagtactacaccccagaacaggagaatacatatcatttcaggtactaacagaccatataccaagatagagtacaacttgggtcataaagctaattaacctcaacaaatgtaaaataattaaaaacatacaaagtg

SEQ ID NO: 750 - DNA, 25356 bp, Homo sapiens
  misc_feature: Incyte ID No: 1330122.10
  unsure 3681, 4013, 4084, 4134, 4527-4828, 5432-5475, 5563-5639, 7650-7733,7794-7828, 7946-8256, 11045-11065, 12156-12190, 22237, 22242, 22244, 22246,22256, 22258, 22261: a, t, c, g, or other
gctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcgggtaagtgaccttccctcagagccggttttcccgcgcgggcgccccctgtgcttgtcatgacccctatattgaggttggcaaatagatgtatgtttatgtgttgaataaaataattaataaaataattaaggtacgtatatatagttttatgactggatatggctttgggtatgaaggcttctgctttatagaaaaatgctgatttttttgttttctattataaatgagtagaaaaaccttgtaagatctgaaatgaagatactggatgtgttaccatagaataaacaaagactggcattgggagactagaaggagctttagaggcagatgggactgggttttggattgtagcacctacttcctaaggactttaaccttctggatcctcagttccttctttgtaagccggaagtaattcatttgggagggtatttgaagataaagtggttatgtgaccttggaggtagttaagtgtagttctgtcattaaagtagctttgtggtcttaggcaagtcgctgtgaacttcattgcctagtttttcattattcccagtttattaatgaagaaactctaaaagataaaacttattatatctaagtttatttcatcagaatcccaaactagatcaaagctgaaatacagttgcttgttaagtaaatgtttgaattagtggtgttggtgcttactactctgctcccatgtattattgccatgaggggtgtgggcctggttttgccagctttttttttctctcttcctcctaccagccagaaatccagattttataggaaatctggttttttttttttgatgttgccaactaattgaatacttaggtaccatggatcaaatgtaatgtatctgtgggttaggttggctctcattttgtaatctagatattcagataattagctgtaggttgtctgtaaatctcttagcatttatgttgacaaagcccaccttgttaattggtcactggtttgcagtaggactgatttcagcaatggcaggcatattcaattcttgaaagtatctatagtttcggatgttgggttgtatatgtgcatttaggctaaaatatacatgtaggcttcagagctgcaccgtgtaaactgtgagggagtgacattcacagtccactttttctttcaatgtctgagtgaatcttgttttaggcatgtattagtactatttggtttgtacccattgtattaacctcttaggtgtttgaaatactactggcatgcaaagattgctttgcctagaaaatatttttttttgctcagagtgtatctgtggaattaaaaatagtttacccatgatccctggaaaatagtattaccatgaaaaaaattcaggtgctctcttggtaaagattatagaggagggaggtgatgacatttttatttttgaccaggctttgtgtttccataaaatagaagccaagttattaccttgactaaccttccttttttgtcttttttttcactcccactccagatagataacatcaaattgcaaataaaacgaactcagatcccaggttgttcttacgtacgttttggcccaaggtgtaattgacttgttttgcttccccttgcaatcatttttactatgattacagtcccaggtaaggtaatttctgtccactttgggcatacctcagtagaggttggtgtagatgaaagcttaaaaatgaaattgcaagtgaaagcacagacttagcaaaacttctttattggagccctcaatcctcataaactggcatttttctgcttctgccccagaatcgagaattcctggttttgtctttgttttgacttgagtttttaaaagtttctctgtaacacctaccctggagtggttaagtgctttaattttgtcaggtgaagaaaccaagtgcagttatggtagccgggttgctgtggatataatccagtttgagaaaattctcattgtggtgatcagaagtgcagtgttgtggttgcatttcagctgctgggaagatgctcttgcaaatccatgtgtcgtctttgcttccgttagaaaggtgcagaatcagtgtaagttccagatatctgctcccttttcattttgtgctcagatgccccgtgtatgaattccggaatataaaacatctgttcagtctggttttgattcagatttaaggtgaatttctgttgctcagttgaaaagctaaatttgagtgtaggctctgtcaggcatgttgtaggaaaggtgtatggtactgaagtgtgtggttttgttttttaactgcttgacactgttaagtaagcaaatgacccagtcatgggttgttttgattgccattcttctgttggtgtactgcttgccttctgttttgttaatagtcatatgagaaaacagttgtatgaagtatagtatcttgaagctttaagacaccaagtttccattaggcagcctaagtctcgcagactttggtagcactgttggtctcatgggaatgccattctcatgtgtggactaagtaagggccaggagattttgcaaattttgtgtgtgtaagaagatcgaagaaaacatttttcctaatgtcactgtcttgagtattttatctgattaggatggactcattggaaactattgataatttcaagatttcttgtcatctggcatacaaagaaaacagtcgtgaccctatttccctggatttttctatccctctacttgtcctgtgtttgcaatgcaagaggaaaatccagctgcctttataatctagaataccatgtttctgtttttatttcttaggtttaattcagggcgtaatttctaccagtccctccaaatactgttaaagttactctttttgtggtcttacttcttacttcttgagtgttatattctccaaaccttggagaaaattagaaggttttaaagttttccaactgaaaagtatctttcagaggaaataccctaatttctgaatcttctatttataacttggcctggagaattataatctggtctaccaggaaggtgcttgtgcttaggttttctgccttagtcacatggaaagatgagcagaagcgattccttctagaaacagtttttttctagaaacataaaattggaaccaagtagactgagaacagaaaaaaaacacaaagttgacctggtaggatgttttacctctataaacctcatagttgctagcctttgagggaggctagatgagttgataataatgcctaaccttagcaatggattgaagtaggggtgcaggggttatgtaggtgtgtatatgtatttaggatatatatacacacctacatattatacacacacacatatgtacaattctcttgaatcctcagccatctaaggttaggtagagctatttccgtgttgggaatggaaaaactgaagaattaaaacacagacttggtcatacgtaatggtaaatacagtagtttaatgaaattttgtattgtacctatcactcagcttcaantgttaatttccagtctgctcacctctgttttctttatcttaaaatttttttcattaatttcccttggctaacatgactaaaaaaatttcagacttaaagagcagttcatttaacacttgtatgatttttgcctagatcactaattgttagaatatgccttattttatctttttttaatctgcgttatttcgagagttgcagacatcttgacatacctttcttaggaataagggccttcctcctaaccacaacatagtcatcacattcaaaacggacattgatacgatactaccaccaaatattcaattcatatagaaatttacgctgttctnccagtaatagtttttagtgttttaattcagtattcaatcaaggatcatatatttacttgtttagtctcctngaacagttccaaagcctttgtcattaataacagtggcactttgaggagtnttggagtccaggcctactgttttgcagaaaccctcactttggagttgactgtagttgcgttttcatgattagagttagattagccattgttgacaggaatgagtatttcatagggatgtcaatgcatcacaccgggaggcataccactttgttaagcagtcatttggttaggtggcattcaccagaatgggccattgtaaatgtaccctatttcccttttgtattaagtgatctatggaataacaaacttgagactgaatattttgttttccaacaatctgcattggttttagcatctgttggtgactgaatcagttattgcaggagtactttaaagcaaacttagatatatcatttcacctgtaagtaattagtgtataagaaataaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaataaggacttttaaacaaccgtagtgcctttacacctaactacaattccttaacacctcatgttcatgttcaaattccctgaattgtcaaaagtgtctgtctacagttttggttgactctgaatctaaacaaggtccacaaattatgtttgcttaatgaccttaagtctcttactctgtaatagcttcttaccccactctttacctttccggatttggctggtcacttatgctgtttatatatattcttctattccaggtaatttctgtagacccataggttctagaaatttgattagattcaggttttgttttgttttgttttgtaagagcacttaagtggtcttgggagggatagatcacatcaagagggacacatgtctgcattttagagaaaaattaatcttggtgtgggtacagatgttagcagctgcatgcgtccattttgaatcccccagcagcctttctcctgaaaattgtagcatccctgtactcatagcctgggtgcattacttcagggcttaccggtggtgattttcctcattacattagtccttttgcatcagttagctggattttatctgacttgtgtttattcctannnnnnnnnnnnnnnnnnnnnnnnnnnnnnnnnnnnnnnnnnnnccctgaaaggtgttgtaaaaggatgcgttctccatctttatttcaaaaaggatgttcatgaactcccttagtgatcctctcaaatgtnnnnnnnnnnnnnnnnnnnnnnnnnnnnnnnnnnnnnnnnnnnnnnnnnnnnnnnnnnnnnnnnnnnnnnnnnnnnncaaacatgtagtgtaaaaatagtggttggcacatggtgtttggtaaatgctagttactaaggtaacttctttagttttgtgggaactctgaactcaagttgtaatggagaggtggaagagggagttcttcatgagttgacatcagggtgcttgggtttctgttgggtgagctgaagggaattgttgcttgccggcactgacctgctctttcagctgtgtgggaacagttgccagacagacacgcacagggaaggtctgcacatatcactgcacactaagaggtggatgtcgacagttgcagcagtaaaacttgaaacacgttccgcatggagttagcacagtgaagggaagtgggccagactggtggtaggtggtaggttgagggagatggtggctccagatacaggtttttactatgtcatgggccactgagatttttatctgaatgaacatatttgtctagtccagtttgccttgtcattacacataccctcaactggagctatttgagattgcagatcactggtggaggagggaggaggctctttttccctttagcctctttaatctgcatctcttgttgcttaaaaaaccactgttgatggtaatataggatattggaagtttagcagtcttgatggcgaagaacttagttgttaatatttgatttttttatttaacaaacatttgagcacctgtaatatgtaagatggtgttctggacactaggacacatcagggaacaacacagaaaattctaccctcatggagtttacatacatggtagtgaggagacagaagaaacgtttaagttttatagcgtgttaggtgttgagtactatggataaatacaaagttggaagggaggcattgagatggtcagggaagttacttttgtgcaaagacgtaaaaggagaggagacaggtcttgtggaaacctggggttacaaagtgttgcctgcataggaaatagccagtcccagaggctagtttggtccattgtgatgaaagggttgactgcttgctgtgctagtgccctgtagtgggccaagggcagaagcatggagacaagaggctgggacagtgatctggatgagatggaatggtgatttgaactaaggtgctagtagttgtctttgattctggatatattttaagtatcgccaacaggctttgctgatggattgattgcatgtgggttgagggagaaagtgagcagtcaaggatgactaaaatttttggactgagcaatagtgaggatgaagttgctgttctgagatggggaggattgagagtagaacacattttttgggcaagagcaaattattcataccccggaacaacaggcaactacaacacttcatccattaagagcagttgtccataaattttactgtgagaacccttgcatttgtagattgtacagctaattcctttaacttaatgttttaaagttgtgggagttgataaagattggcttagatagaatctatagctgtgatgactgggtcaagtatagaatacacttaagacttactatttttccccttctggtggaatgactaattaacactgataaaaagaatgaaggcagaaagcgttgaacttggatggtgagaacatagatacgtctggtcttacagctgacccatcagggctttgctgtatgtgaagcctatgcctgggacttctttttacttttaatctctgcattttatccatacacatccattcacatgatcacacaaagatttcaactggtttttatcttacgtgctgtttgcagtcttactttgttaacagttgttacatatccatcttgtgtattttcaagcacaactttttaaacacgcatgatcttttatcaatatcgttaatgtttcttcctgtcagtaatgtccttttcactgaaggtagtattgcatagtgattaagggcaaaagctgtttagacatatagatgtgaggcaacatcctggctgtaacacagacagctgtggcctggggtgagtnnnnnnnnnnnnnnnnnnnnnnnnnnnnnnnnnnnnnnnnnnnnnnnnnnnnnnnnnnnnnnnnnnnnnnnnnnnnnnnnnnnngtaatgcacataaaactagacacagtacctagatggtgttaggacttaggttagtgtaagnnnnnnnnnnnnnnnnnnnnnnnnnnnnnnnnnnnctcacttatctttgataaacagtcttttacaagcagatagtgttgagcctcttgaattcttattgagttacacaaatgtttggttaagattacatagtaataggcattgctgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttatctttaacaaaatgggttgttgggagtttgctcctatatgtgatctagtatcattcacataaaagttaaaaccagtagtagtttcatagttgttcttccctccctgactgccatatctacaaggtcttatttctctgagatttctataaaaaaattcatgatgagccaaacttattggtagaatcaggttaaaatgaatatatcttgggcggagtgtatatggatgaagtaaatctggtggtttatgaacttttctaggtgaataagattttatttgaggaaatggtttactttggaaattatccattcttaacccctccccactcctgtcccgggagaaactgataaaagtagagctgttctggtggtagagggttggaaggagggccgcagtccctccctactctgcctcaacttcacccatcagaatacagcttcagcaccatttgagtccaatcagggttttgtataattaataacttttaaaaagttgagggtgcaagtttaatagaaatgttttgtcaaaaagatttaagggcaaattctttatattttagggatggttaaaacattacggtacaagttgaataccccttatctgaaatgcttgggaccagaagtgttttggattgtgggatattgcatattacttggtggctgagcatcccatatctgaacatcccaaacccaaaatgctccagtgagcatttcctttgagcatcatgtcagttctcaaaaagttttggatttgggaggagcatttcagattttgtatttttgcattagggatacttaatctgtagtgttgtctttagctccacttacaatttaaaactggctggagttcaggccagttatattaggaaaacctgttttgctctttgtgttactgatgaaccgctacagtatccttgctccacatttttaaagtaagcaggggttgaggacagtcctatgtgagtacacatacactctgcatcaagcgttagtagtctattccaccacaggaatttgctttcctagaacttgagtcaaggtgacaaaagtgaaagcatgtatgtaaagtcttaagaattttatatacattttttctttttgtattttacttgaagtgatttaagtaggagctaatagttgatgagacagttgggagtctaaaatgtttgagagagctgcatctttaatgcattattttatctaatctttctatatataaataacttgggaaaatcctaatatgccttgcacatagttgacagtttaatttgaaaggaactaatatcacttctagtatattcaggttgtagggagtaaactgacatttactgagccacctccccattgcactgggcaatactagctttctctgttacttattccttataaatcataaggagcaagttggtttcattttaaaagccagacagttgagacttgttgaggctcatagagatgaagttgttgcctgagatcctacagttaggaagtgacggagcatggaacccagcccttaaaaactgtgctgttttcttctgtaccgtgccacctacatagatgtggtacctacacccacctcccttcttacagaatcatgaaatctgtctgttggggtggggagaaaacaagcttgggtatgcccatgttttttgtttttggtaggttacacaaaagtgattgtaattcaggtaattagttttcagaggtgtctgtgtgttctataacccttcaattattagctggctaagtgaatatttttcatttggatcagaggatgagcagggctcatcaagcttaccattgacagagtgctggactaggcgtctcagattgtaccttgagtgtgtggtttgtaaattgactccaaagctaaaagaggtggttgtttggtcacgtttaagattattgcgtactactctttgcaggccccgccctgtgtcattgaacttatgacttgaagccctgagtataggagataatttttcttgttccttgtttggttttagtggcaggtggttttttattttattatttttttgatagagtgcccatatatcctgctgtttacatatagttccagaataagtttctggtttggaagataaattatatggtcacccagacagtactagagagatctggtcatgataactaattacattttggttaacatggttatatcacctgaaggagtgcttatttaaatttggtcttacctttttttctctttctatttggtcaaatgcagcaaatatttatatttacacttctctatttggattaattcttcagttgcaatttaatttatccagatgcgtggaatagaaccaaaactgcattctaattctgtgcaaaacaataaaatactactttctgagaaggatgccttctcttttgggaagaaggggaatctgctctgtttcaagcacctttgtgttcaaggtttggctaaatctgctcatcaccactaggggactgtttctttttgcattctacaagtattactcccattacagaagctttttaagaaaaaaatggactaccaaggaacccacctacatgcttttcataactatacctattttattgtcttataatttttacttgagaggtctgcgtgaatgatgaactgtgacaaaaagcatatataaatataaaaatacaagttaaaaagcctcatgttagctgaagattttccatgtgtattcttataaaaataagggaaccctggacagtgctcattgtattttgttgaagaaatgttaacttctttaaaagggaggannnnnnnnnnnnnnnnnnnnnacatactgtatattcagaaccatttttaagggatgtagtttatctcttgaaagactgaaattcaaggctgtgactatgactagagtgtaaaatatagctgcattgcattatagtattttatatatttgtacaaaccaaattgacctgtttttggttttgtttttccttttccagtctttaccaggtgctggtctctgcatgtgttttgttggaagttggaaaatgtagacacgacccacagagtggtatggtatccagtgagaagggaactgtccgcagtggctttgaaggatatgaggaagcctaggcggagagttgagaattcagccttgagctagtgttagggtactatttggtacctctcctgtgggcagagcgactttactagagaagttaggagttagggctagcatgagaacttcatgcagtttgagcattcatcaggcagcagaatatagcttctatatttaccttgcataaatcagatttgacaatgaagaacaatgttactgatagtaacagtgcttcccagtgattgaggaagtgcttgttttctttttcagcactttgttctatgaacaaataaggtgcagcagctagtatgacacataacccaccgtatttcccccccaacggccagatgaaaccagaaatacccactgtgtttttctctcccttctttggaaagcacgtggttggtactgccattgggaagagtgatacctgattagccaggtagccttctgaaaattgaaacaagtggcctgaggatgacttggatggctgttgggtagcagagagccctggaggcagggtttcataactgcgaacagcagttttcattgtaattgacacagcagatttcattgtaattgacaagcttcccttatgcagaaacatttaacgatacctttttaaataatgtttactagtcatctgattagattttattaaaaatttagatgattcgtcctacataatgtcaaagcatttgtttaaaaacttggaagcttttgggggtggggaaggtggtcatagaaatatgatcatcttcaggatttggcaggtatgaagtgatacaaacctcaacnnnnnnnnnnnnnnnnnnnnnnnnnnnnnnnnnnnggcaatcaatcttatttatgccagccgttgacacttagaaaggatttaaatcacttttcatagcataattattgtattgcttaatgctttaaaaaggcacgcagatgggattgagacatttctatccaggcagttttttctgcattagacctaagaacctaattttgtagggcagtagtctctaggcattatgtttagctccttttgtcagtgagaagtgtgttgtaaagtttctaatactgtggtctgttttgaacggttttgagaagaggtagctttagtataatttataggacttaaaaggaaaatgcctagaatcatcagaaaaagcatggaaaaacattcttctctgaggttgccttattggaaaaggagaaatcatttagaagttaatgtgtggaaggcattaggttgaataaaattgttgttcgtattgatctgtcagctgcaattacaattaactgaaaatttagtatttgtctctttttcaggagagaagccgtcaaattttaatacatttaattttaggtatatttaaatgtctgttttgcagagtgattatcttaatccagaactgaaaaattcctgatggtcctactgaagatttatctaatggtccacaaatgtctgttttgttgaggtttggcggacataataataaatcattttttagtcttctgaaaacttttctcctcctccctcttttctctgcttcttatacccttcaacaaaaagcattaaaaggaaaacataaaatcacgcctttagtcagtgccgttatcctctcagaggttgttttggaaatactgcctgatgaaaaggaagagaaggaaattgcttcttttaaagtttgctttttatcttcttgcagcatcttctaactggcagaaataatacaatttttgagttgttttgtaagttggatatttttagttttgtgtggaatgtcgtgtttcccattagggcagggggcgtctcacaagatctaggttactgtatgacaactatatccatttactggagtttaagaagctttataacaatacatttccagagactaggcagtacttggttttctgtatttaaattttctgagggtagatgataacatctagtaaacaccacctgcctgttccatccaggaccctaactggccataaagttacccccaaactctcctaggattcatagtattttaagatttcatttttgtgcccttattacgaatataattagtgttttctcccctttagggtgctttaagatcttagtgcctgtcctaatctgagcataccacagtaagacaagaaagggcaatgctgtggtaggcagttagctgctgaagttaggccacttagttatgaggtagatgaatttctgtcctcagctcaaaatgataatattctcactgacaaaagtatcagctgtgatcatatagattgctctttcctgtggaactgaagtgtattaaaaaaattttttttcttccaataaagaatgtctcgttgcgccgggtttgctagactgaaagtttcctcatcacgtggcgagacctcctctacttcaatctttgtcttttgtctctgctgccttgcagggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtaacaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccatacaaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaagttttttttctgtctctgtaatccctcctaccattaagaaaaacttatttcttagacattgtacaatcagttatgtactgaaaatcgaatgtgcttgtgtgatacttgtttcaggacaagttcatttgccaggttcattttgttagcatgagcctacggattctgatttcccaaagaaagaatgttttcctgtaggtatttttgtaccaccagtatatggaatgttagggaaaaactttgttccagttcctttttttttttctttctactttcaagtttaagtgaaccatactgaaatgaccaacaagtctgcctgtaaagttacatgtcatgattgtgttgttaaatgattatgggggagaaaatgaagtaaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagacttccatctgtacacagcctccacatttttgttgtagtgacttagagcataaggatgtttcagtgccaattccggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgatttactaggctgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacactactgtgtaattcactgataattgacatattggctgggcagcctatctcttccatatccagcgtaaatgaataggaggtgtctgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcaatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaattccacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaatttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaagggngtatnangntaacgaatancntgnatgacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcatcattattttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttatatttctgtgactaagtattttcagtatgaacactgccacaatgtagtgttctgggtctcagagttgaagaagagtattgtacctcgagtttctttatgcccttggcccatagaatggtttccagtgaatttccccctactaatattttagtcatttttaatctttgtaaacac

SEQ ID NO: 751 - DNA, 1022 bp, Homo sapiens
  misc_feature: Incyte ID No: 407468.1
  unsure 886-910: a, t, c, g, or other
tgtttaggctttttatagcctatgttcttatgagcagtaaacattatgatggtttagttagacctgttgaattgaattcacttcttctgcctgtggtcaggtatcaggtagcacagccacagaagttactgaatgtctttgttggtggactttaggagagtggtttaatttatgtggtattctatctgggattgcagcagtattgttagattgcattttgtcacagggaggaaattacctggtaactcctgattaggaacaaaatgaagcttcccctttttacaaatcctggctaacattccatttggctctcttctgttgaccacctctctctctcccctccctcctcactccattttctcagttattttattgtttactattggaagtcacctcccaactcaggatacttgttagtccattttaggaaaaatatcaccattctttcactattattctctgttgaagttgaagaacagaatattactttttttctttccattattggttacaccagctagttagagacttggggtaatactgtgggcatgggttggatcctgatatctgtgtcagttagtgagagttggttctatgaccctagagctctttgtgtccttcaaacgaaggtgctgaaacaagaccgaaccatagaactgtctataccaagcaaaaaactcctgaaagcacatgcccactgcaggtgaattggtagcatagtgtggagataagtgggcagtgcttggtcctgtttctacctcctagagagtacctctcagcatccagggatgctttagtaactcttagttaaaacgaaatgaactataattaattacctttcttttgggagggacacagagagtttcaacagcatctacaatgcttnnnnnnnnnnnnnnnnnnnnnnnnntgatagaatattaagattgacagagctggggatgggttggaggctgaattatgatgtgtgttttctttatgcttgaattatttcataattaaaaacaaaacatatctataac

SEQ ID NO: 752 - DNA, 4219 bp, Homo sapiens
  misc_feature: Incyte ID No: 1330149.46
  unsure 1665-1703, 3787, 3883: a, t, c, g, or other
cttagtttactgactaagactttcagatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccagcaggtcctacacctacgatagctactatagcaggagtcggagtcgaagtagaagccagagaagtgacagttaccaccgaggcagaagttgtaatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactannnnnnnnnnnnnnnnnnnnnnnnnnnnnnnnnnnnnnngtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggacggaattccgaaaccttttattggcacaggcattccttgttaacttgacagggtgaagctgtaatttttcaaaaacagtaaaagctggtttctcctaaactattttccttgtggtagtagagatcagtgggtcagaaacaactcctgaccacttggtttccttttgagccgcgtcataaggaggcaatctgtaaaactagcacaggtctcccgctgttccactggctcacccacatgattagcagagtgcacgaaaaaataaaacttctattaaagaatcatgctgagcacaagatcagagaggttgtgacattgcaaactcgatagatgcagggggcctgggagactggcgttctccaaagggctccaacaccgtctctcctctgatttctgtgacaaatgtggaaagctacttgcttggaggtactgggggaactgatgggggaactttcatcctgttaggaactccgctttccattcctgcgtctctgtcttgctccctggagatggatggatcacggagggggccacagtcagctggggcagcaggtactcctacggcactagtctacagggggaaggacgctctgtgctggcagcggtggctcacatggcctgtctgcactgtaaccacaggctgggatgtagccaggactggcacgacaggcccacggcagattagancttttcccagtactgatcggtgcgtggaattccagccaccacttctgattcgattccacagtgatcctgtcctctgagtattttaaagaagccatngtcaccccagtcagtgttccaggagttggcaaccagccagtagggtgtgccattctccactccccagcccaggatgcggatggcatggccacccatcatctctccggtgacgtgttggtacactcctgacttgtagagcaggaagtccgaatacacagagaaagctccctccacggggccgtttttgtagatctcggccatgatgtccttctcgctattggagacgctgtaggaattgtatccgtagtgcttgtcctgtttgtaggtcgggctgtagccaggctcacagatcttgctacacttgggggtatctccctcccccgtgcatggggccgg

SEQ ID NO: 753 - DNA, 2725 bp, Homo sapiens
  misc_feature: Incyte ID No: 032476.2
tcctcatactatacacttttatcataatgagaaccagtgaagaaataagattaattgaatggtaatttactttttggatatcttttcaggaatgtactacttctgtatgtaggatacttgttatgaagacctttccaaattcatttgtatttctgttaaatttattttttacttttagagtggctatcattataatgtaatttaaaattatatttgtaaaagtgactattggagtgagtacgaattttgtttataaatctatgataaatgcattctccctttaggaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaacaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggcaaaaagagctacaatcaagcagtgaacaaaatacctttttaattaataaattgcataaagctgaacgagaaataaatacattgtccagtaaagtacaagaacttaaacattcaaacaaactggaaataacagacatcaaactggagacagcaagagctaagagtgagctagaaagagaaaggaataagcttcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagccgtatcacagacagagaagaaaagtacaatcaagctaaggagaaactgcagcgagctgcaattgcccagaaaaagagaaaatctcttcatgaaaacaaattgaaaagactacaagagttttgtagcaagtcttggaggcaaagaacgaagacttggcacacacagacaatcaggtcttaaatagacaaaatgtccctcttctgcacagactatacacggcttcaaaaaaagactaaaagatatacagagaagacataatgaatttcgaagtctaattttggttcctaacatgcctccaacagcatctatcaatcctgttagctttcagtcatcagccatggttccaaagcatggaactaccatttcctcctcatatgcaggaggaacaacatcaaagggaactctctctacttcgcaaaagactagaagaactggaaacaacacaaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtaccctactacatgctgtattgtatggactgtccgggattttaagattatcccaagtgaagcattaaaaagagaaattctccagagatatttagaatatttgacaatggtttgagaatgtaaaacacaaaaggaactagttagagtcaagttttaaaatttttactttgttgaattttttttttgggcatttggagtgaaatataactatcattaattctctcttcatctttgagatgctgggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtcctttaataaacattgttggtatttaactttaaaaaaaaa

SEQ ID NO: 754 - DNA, 3464 bp, Homo sapiens
  misc_feature: Incyte ID No: 1281694CB1
ttcgtgaagcactccatggagcatgtgtcaatggcctgtgtccacctggcttccaagatagaagaggccccaagacgcatacgggacgtcatcaatgtgtttcaccgccttcgacagctgagagacaaaaaataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtgaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagctttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaagcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaa

SEQ ID NO: 755 - protein, 298 aa, Homo sapiens
  misc_feature: Incyte ID No: 1281694CD1
MNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 756 - DNA, 6348 bp, Homo sapiens
  misc_feature: Incyte ID No: 1719478CB1
ctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacaactgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccgccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtacggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattgattcagttttttggtttttaataaatcagaagaccatgtagaaaacttttacatctgccttgtcatcttttcacaggattgtaattagtcttgtttcccatgtaaataaacaaccacg

SEQ ID NO: 757 - protein, 1977 aa, Homo sapiens
  misc_feature: Incyte ID No: 1719478CD1
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 758 - DNA, 64 bp, Homo sapiens
  misc_feature: Incyte ID No: 230611.1
aatttgattgcattgatcgtctgacatgataatgtatttttgtcctctaagaagttctgagctt

SEQ ID NO: 759 - DNA, 1745 bp, Homo sapiens
  misc_feature: Incyte ID No: 236749.1
ctgaaacaaagtacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaagtgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttc

SEQ ID NO: 760 - DNA, 1453 bp, Homo sapiens
  misc_feature: Incyte ID No: 407124.2
actttgtgaaagaaaacattggggtttctttggctgttcttgataagcctataaaaaatgatattttttagttgcttatagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaatgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtttataaaaa

SEQ ID NO: 761 - DNA, 918 bp, Homo sapiens
  misc_feature: Incyte ID No: 104322.1
ttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaattccaggtgagccgtggcaacaacctctaaaggatctaggaacctaaagaggatctgccttttatttaatagaaatcttagaaacaaaaataactggacatg

SEQ ID NO: 762 - DNA, 2171 bp, Homo sapiens
  misc_feature: Incyte ID No: 400253.14
ctccgggtgggcgtcggggccgctagctgcggggaagggccgcggcggcggcgactgacagctgggccccggcccctgcctcacaattgaaaaaattaaagctaacatgcttcattaattctggaaatatttactgaaactctgttaaattcaaaattgtatgtttctgtaggctaccattttaaagttctgatgaccaactgtttattagaatactaaaaatgtggccaagcggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagctttaattgaaaactgtaaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaacct

SEQ ID NO: 763 - DNA, 787 bp, Homo sapiens
  misc_feature: Incyte ID No: 233595.17
gcattcccggtgtcgcacttactagctgcaaggcctctgcctgccttcctgcgcgccgttccccgctagtcgcttgtggttgggggggcattcgccgggtttttccttcccacggcctcgagatggtggtgaatgtggcacggaggagccgggccttccaacccggtgggcccgagctccgagaaggccccctcggcagtgagaggggccgggagcccgcggggggccgcgcccttctctcgcttcggactgcgcaacgctgcgcttctgggctgacaggcggataaaacggtcccatctagactgttgataaagcactaccagctattggcacagcgtgggcagtggggcctacaggatgactgacttagtctactgagtttcccggcgtacttaagcaggtagtaatgatggacagatgaagactcttaagatgacagaaggtgatttttctggtgatcgaggactttccggggtaatgacagtgatgaaatgccaggggacctggttgcccccaagtttcctggcagtgtgtgatactgaggaggtgagcttgtttctggagctgtgctttaagattcatgttacatgtaaagctgtcctcatttgtgaactaatggagcatatggagttgggtcagtctctaatgggaaacagaaggacaggaccccggtcattttaggtagaaacaacagcatgctaatgcaaaaaattatgcagtgtgctactgaacttcagaggtgatcaataaaagaagaataaaaagactaataaaagttaaaaaaaa

SEQ ID NO: 764 - DNA, 1881 bp, Homo sapiens
  misc_feature: Incyte ID No: 978065.5
  unsure 1775: a, t, c, g, or other
atcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtcaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgtgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatggtctcagacttataacgacattaagtgatacatatatgttagtaaaagacatacttggctaccatgtaattcagagagtccacacancctttgaaagttttaagcagggtctgaaaacccttggtgttttggagaaaattcaggcttatccagaagcattttgtagcatcctgtgtcataaacctgagaggct

SEQ ID NO: 765 - DNA, 429 bp, Homo sapiens
  misc_feature: Incyte ID No: 403642.1
gctcgagggaaaaagctatgtatatgactttcaacaattaaaatgcatatttatgttaataagatagcagtctatgaagtaggaaatcttttcagaaaatcctaacattccaaattgccttttttttcaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagtaagttttctcgattatgtctagatcatagtttagtaaccatctccttgattgctacctggaaaatgtcaatcacattgcactattgtgtgaccaaacttgagaggtcatcattggtatttcatctttttga

SEQ ID NO: 766 - DNA, 1550 bp, Homo sapiens
  misc_feature: Incyte ID No: 984236.4
  unsure 160: a, t, c, g, or other
gccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtganagagagagatagcggtggggtagtaaagacagaaatggcccactctgatctgtcttggccttggttgggggacgggcaacaggtttacaatcctaggatccgagcagaattccaagtgttgaggccaatcagcaagtgtcaggcagaggcaagacgattgcgagcaagagggttcccaccaggtaagagcctttgccctcactgaaataaaaaacccaagagtcaccaacatgcaagccctgagaaatctacagtggtcttctttcccaggtctttttcccctcaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctggtgagcacctctcctgcccaagcactgccatctgaccacccagttctgaaacttcatatcctgtaagccctgtttcctcaccagctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacaggtataaatcgctgctgtaaatccatagctcttgaaaccacttcagcccttcctcttgggtttggtgctcctgaggctagccctttcctctctgctccagttgccacccctcacaatgcctaaagaaccaggcttagtcacccatctccctcttgtctctttagccttttttctctgctggttcttgccctcagcatgcttaaatctctcctaatctgttattgctaaaactcacacacccctcttcctcaaccctatcctccccttcagctatgcagcatgatttctatcctgttctaactggtgtattgctcacccactgcactccagcttcaggtctaccatgccagtgaaacagctttcaactcaccagtgaccttccaggtacctaatccagtggatacttttgaacccttattcatgaccttcttttgacacttgagattgctgaccgctccaccttgaaactgcctcctccctaggcctctgtaacgctgctcctcatggatttcatcctacgtctctggtcatcccctttatcttttccttgagctctttgtcctcttcttatccattgtaaattggtcctcagggttctattcttgcctcttttgtcttctattccctgaactctctgagcaagttatccacacccatggtttgaagtgct

SEQ ID NO: 767 - DNA, 903 bp, Homo sapiens
  misc_feature: Incyte ID No: 984236.1
cggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgcc

SEQ ID NO: 768 - DNA, 5724 bp, Homo sapiens
  misc_feature: Incyte ID No: 1001589CB1
cggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggcttttacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacagtactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacaaaaaaaaaaaa

SEQ ID NO: 769 - protein, 1645 aa, Homo sapiens
  misc_feature: Incyte ID No: 1001589CD1
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFYPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQYSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 770 - DNA, 3221 bp, Homo sapiens
  misc_feature: Incyte ID No: 007808.1
gcggccgcggagtggagggggagtcccgtctgacgtgagacggcaggcctgggcgggcgggcgggggtgccgcgaagggcggatcgtccgggcatggggatgagctaagcgggctcagagcgccgcgcgcattcagcccctcggggttccgctaccgcgcgtgcggagttccggcgccgctctccgagctcgatccgcttctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgagaaattattcagagtactccctatgggcgccccgcaaatattagtgggagtacctcatcacaaagaatttatatcacttaccgaagagcctctgaaaacatgactcagaatacgttggctgtcactgacaatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttaacaaagctgggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatggcattcaggaagtttctgacttttctggtatcgttaattccatctctggggctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgctatactagtgtgacagaagcattagtgtctatgattttccctttccactggcaatgcccgtatgttcctctctgcccactggctttagcagatgtcttgagtgcaccatgtccattcatagtagggattgattcaagatactttgatctctatgatcctccaccagatgtcagttgtgttgatgtagataccaacactatatctcaaataaggtgaccagaaaaatgtagcctggaagatacttccaaagaagccatgtaaaaatctgatgaacacactggataatttgggtcccagaattggccaaaattgcagcagagaccgagagatgaagggactcatggatttagcaataaatgactatgatatttaattctcggcaagaggttgcccatgatagaatttggaaatccaagaggcatttttggtttttcatgggctctattttaacaaggttacagatcatacttaagggcaataacacaaggcccaatctgagacagccacagatgcagcctctctctttggcctaaaagctttcttaagaagccgggaccggtccccttcaaaaatcctataacatgatgaccaaaacacaaatgtttattcgcttcattgaacgaatgttcttcttgttagtgacaaagatgcgagcctggcattttttgatgattgtgtagataaagtggatatggacaagagcggtgaagtacgacttatagaactggatgaatctttcaaaagtgaacacactaaaaaaaaaaacaccacctaagatcccccatctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgctaagaggtactcttccatccctcagatgtggtctaagtgtctactgcgccactgttatggactgtggtttatatgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcaccttcatcaccaacaactctctcggccgatggcagtgacctggatgctgttagtcatggcagcatggatagtggtcatgggacacacactgtggagcaggcaccatctaatacgggtttaatcaaagtatatgctactgatgatagatctagtacaggtggccagtctgatcatggatataattcattatctaaagatga

SEQ ID NO: 771 - DNA, 1097 bp, Homo sapiens
  misc_feature: Incyte ID No: 403627.38
tggacaagtagattctaggaagcatgaccaaggctatctgacagtggcaggaggtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccatggccacgggcattctccatctccttgcaggtctgtgtacactgggctcagtaagttgttatgttgctggaatggaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaa

SEQ ID NO: 772 - DNA, 785 bp, Homo sapiens
  misc_feature: Incyte ID No: 106415.1
aaatgagattgtagtaagtgaaaatgcatttataagtataggcaaatttttaggcaagacacctcataaagatcactttagaaattagatcaagtaaaaataagtcacaaaaagaaacgtgaattagtcatcttaaacattgttttaggcagtaaaacaacattgaaaaaagaggaacttgtaaagcctgatacttgattcctataggataactgaatcaaatcagatgttttagaggtaatggtcacctgattgttttctcttgagttttttcatataataggtgcagtggttcttgcaatgaggaatttttttatggaaatgtgaaataaagtacagaaattcctaatgaaaacctgtcttttaagtggatctctaaattctaagaaagtgcttatattatcttagttatttagctattagcctgtcaatcattaggaaagtaagagcaatttacaaagcatctaccactgtgctagtacttgctcacatgttctcatccacctaagggaatattcaaagcatcttaatagttgctactaattcatataatttaattaatagaatagcaaatacattctcatcttatttcacatttttaacatacacaagatatagctattttatagtgattaggtttagtaaaaataacactgataaaactcaactgttagcatgtacagttttaggctacatatttttcaaaacaacaaaatataatttttttagactcaacttgaaattttgtaaaaaataaagtttcagaaatagtaaactatcacaga

SEQ ID NO: 773 - DNA, 4418 bp, Homo sapiens
  misc_feature: Incyte ID No: 474622.1
cgccgccgccggtgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccggccgccgcggagggtcaccaacgtggggtccctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctttgatctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagatttttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatccttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatgaggagtttgtacaaaagttaaatggaacattataattattttaagtaatgttaattgaaaaatttttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaa

SEQ ID NO: 774 - DNA, 1557 bp, Homo sapiens
  misc_feature: Incyte ID No: 1383009.57
cggtcctaaggtagccagcgcagggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtaggggcaaaatatgttttcagttctttttcccttaggtctgtctagaatcctaaaggcaaatgactcaaggtgtaacagaaaacaagaaaatccaatatcaggataatcagaccaccacaggttttacagtcttatacgaaactagagcaagttctcacgttga

SEQ ID NO: 775 - DNA, 3227 bp, Homo sapiens
  misc_feature: Incyte ID No: 1383009.67
cgcctctccatgcccgctccttcctttccagttcctctgccagtcattgtccttgacccttccctctcctcgtctctgctcccaccggctcgtctgagcctggcgctgacagccttctccccaccccggccaaacccgacccctgactcccgccatcccctcgcctcctggtccctgtccccctcccgcgtccccgtcttcttgatgactccaacagctgctgagggggcaggcggagcttgaggaaaccgcagataagtttttttctctttgaaagatagagattaatacaactacttaaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggtttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 776 - DNA, 416 bp, Homo sapiens
  misc_feature: Incyte ID No: 1086355.2
agagtggagttggctttagagaatttgcttatggaaatttttttctttcagcctgtcttaatgtgacctcttatttgtgtgaaaaatggcatgaggtttccctgctgtgggagaatgtggatactttgtagtttactttctcgatattttttttctgagatcttccccttgttgttaatactaattttgtgctctcacaagcaccctccccaagcccttatactgcgctctgcccctcacttagggcctgagctatggaattggccctagggcagcaggaacctattgtttcagaagtcggtgacctttgaggacgtggctgtgtacttcacccaggcggaatgggatggcctgtcccctgcacagagggaccctgtacagggatgtgatgctggagaatttatggggaatgtggc

SEQ ID NO: 777 - DNA, 686 bp, Homo sapiens
  misc_feature: Incyte ID No: 1086355.1
cacactggggagaaacccttcagatgtgtggaatgtggcaaagggcttcagctttagttctgactacattatacatcagacagtccacacttgggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaa

SEQ ID NO: 778 - DNA, 493 bp, Homo sapiens
  misc_feature: Incyte ID No: 998330.2
  unsure 18, 40, 49: a, t, c, g, or other
atttctttcacgcttcantgaaacacagatgtttgccacntttattganaataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaagtaagcatgttcttcacttgagtagttggttgaaggaatgaatgaagggtggggtgctctgcaactcaaatggacaatgcttaactattaaacatctatctgattacttttttcatgaccacattaatgcatttgaaatatggattga

SEQ ID NO: 779 - DNA, 1456 bp, Homo sapiens
  misc_feature: Incyte ID No: 1384716.4
  unsure 1453: a, t, c, g, or other
tttatcaaaacagggtcttagtctagcttatccttgagtttggagttctaacatactccaattttgcccatacttgtgtgtacataagaaaatgagaaaaggaagataaagaaaaattacacacaaaattatttaagtcatatttataaaaaaatgttccctcctttcaagccctagatttggaaagtaagcaaggaaaagagggaacagtctagctaggaaaagagggaagagtcagttggtgaatccagagataatgttttgggactcctgaaaaattaaattttttcggctcgagctcgagccgcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattcctgagatcaacaagaagatttataagattggccaggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatgaatgctttcttctcctccatggtctggaagcattcatgggaccactgaagaaagaccgaattgcaaaggaagaaggagcttaatgccaggaacagattttgcagttggtggggtctcaataaaagttattttccactgaataanaaa

SEQ ID NO: 780 - DNA, 1079 bp, Homo sapiens
  misc_feature: Incyte ID No: 2790762CB1
ccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaaa

SEQ ID NO: 781 - protein, 247 aa, Homo sapiens
  misc_feature: Incyte ID No: 2790762CD1
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEVCWQPLL

SEQ ID NO: 782 - DNA, 1000 bp, Homo sapiens
  misc_feature: Incyte ID No: 399607.1
  unsure 38, 113: a, t, c, g, or other
cagagtatattaaattacctacttacgatgcatgaggntgaaaatattcatgatgtgctacagttactggtggctttaatgtcggaacacccagcctcaatgataccagcatntgatcaaagaaatggaataagggtgatctacaaattatcggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaacgattacactgtcagcacagatactcgagacttactcatgtctaccaaagtgtccgatgata

SEQ ID NO: 783 - DNA, 427 bp, Homo sapiens
  misc_feature: Incyte ID No: 256138.1
  unsure 35, 422: a, t, c, g, or other
gagcgaactagtctcgagatttttgtttttttttnttttttttatatattttagatccctgttaaagatttaggacaacacttaggaatagctaagagactttttatttaaaagatttggagaaatcatagagttgtggaaatagatcaaagtgatgaagttcagatgatctcttctaaaactttcatttaacagttgagaaaaccaaggtaccaagagattaagtgatttacctaaggtttctctaatgccagtaattgtcctgtagctttgaaatgtgttttctgaatttgtggtgcaattgtggtaggtacttcattctcttgttttgttctactttttttttccctcccttctggatgtgactctgaggaagtaagtccttacctcctctctctcctagtcttaaaatgaatatatgntcttt

SEQ ID NO: 784 - DNA, 3036 bp, Homo sapiens
  misc_feature: Incyte ID No: 413348.40
ggtaaacaacaggactataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgatagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaatcagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatattcacgtgttaagtatttcctggatcttaaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactatttaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgttttttttcttcttgaaaatgctgaagtttccttctgtagatactttgtggcaaaacagtagaatcctgatatgattttgatttagtctgaactcttgctagtttggcatcaaactgaatcaaattgaaaagaaagttattgaaactctagacaattagaaacaattgtttctataattataatccatgttatcctttgacatgtaatctgtaattcaggtgtaaattacagtatagacaatagaaaaatctttctttaagaaataatttttcagaaagagcaaagaacagaaaaacaagattaaccctgattgcacggtaaaattacctggagaggttttttttttctttgtttctaaagtaccaaatgcctgggcactactttagagattctggtgtgcagctagcgtcatctttttctcaaaacatcacgtgattctatagtgcagacagggtttagaatctagtttaacttaaatataggtaaaaatatttttacgttaaaatgagtgtattataaagaaaatgtaataaacagtcaaggaagaaaacctcacgtagctttctgcaggaactttgaggctgaacagtagaatttgaatacgatcttgtcgatatagtttgaacccttgctggcttcaattaaactgaatcaggttaaaaaagttctcataggccattcttaacaggccatttttttttgtttt

SEQ ID NO: 785 - DNA, 630 bp, Homo sapiens
  misc_feature: Incyte ID No: 332088.2
tctttcatcaccacctagttgaactttaaaacagacgtctacttttcattattcagaagcaacttgttacttcctttcttcatatgtgcagagatacacatgatcatgttacaatttgaagtgttttaatgtgtttttttttcttttgaaacgtaaagccttcagttgttgaatcatctgccgatttttatatgaagcacattagcaaacctggagctattagtatttcagaattcacaaccagctgtacttgtgactaaccaacacatgaactgaagctcacactttgctaagacctttggttgacattcgattttgaacctgccagatgcatttgtgtgaaccagggatactgcatctttaatgaacaagtctctcctctttcccctgtttttaaatacaacacaagcagtgtagcactaggcactgcaattgtcaaagacaattagactggaagcaggaaaatttcacctccctgtctcagtgatatgtagaatgtcggcagcatgggtcagccttgccacagagttgtgtgagaatatatgaatcagtcctatagaatgttaaatatttataaaatggttctgtagtacaccaaggttgggacacattcattccttcttatttcgt

SEQ ID NO: 786 - DNA, 2451 bp, Homo sapiens
  misc_feature: Incyte ID No: 035282CB1
ctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagatctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaaaaaaaaaaaaa

SEQ ID NO: 787 - protein, 660 aa, Homo sapiens
  misc_feature: Incyte ID No: 035282CD1
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERSGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKVNGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 788 - DNA, 905 bp, Homo sapiens
  misc_feature: Incyte ID No: 350667.7
atgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcagtaagtttttgaaatgtatgttaattgttatgaaatttattgcttagtataacatgtatgtaataattgtttgatttcagagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacacc

SEQ ID NO: 789 - DNA, 488 bp, Homo sapiens
  misc_feature: Incyte ID No: 343913.1
cacagattaagcagatggcactgagaaggcctgtttctgtgtcatccatttccaaaggcaggagctggttggcaaaggtgaacacaaggtcagtcagaggaccaaatccagcattgtgcatctgagttcgatttagggtaaggccgtctgagaaagtcatggtgtcttgttctggggtatacctggtgcaaattctaagaatctggaaggaaaaaaaaattgatggatgttctaagccatcctgtcctgaaatcatcaatcagatgtaagcaggaaataacatgaagatttccaaggagctcttggggcagtctgtccccctttcacatgttgaatgtcttctttagctctttcattaagagactacagaagtcaaaacccaggggctaaagttttttaggaaacactaaacaggacataagaaattttgagaaatatctttttaaaagtaattcattacttgactcaaataaacatttactgagtgc

SEQ ID NO: 790 - DNA, 701 bp, Homo sapiens
  misc_feature: Incyte ID No: 211622.1
gctttcatatatgcctttattttttgtgacaagcctgtcaaaatttcttggcatttttcttctaagatatcccttcttctcatcagtttttggcctttatgcattctggattggagttctttgttaagttatatatgcgttgcagatatcttcctcttctttcctgcaggctgtgttaaacagaaattcttaaatttagtaaagtctgctttattaatcttttcgttcaagattagttttttaggaaaatttttgttgatgatagtggtgttgattaagcaatccttcactaccaaaaagttatgaaactattcttgtaatgtttgatgagcgatgacaattcaatgaggaaagatgatttttttcttttaggcattttagtgttctttcacatttagaactgtaattctaaataggttttgtgttcatattgaagtcaagatcaggtatcatctcccctcattccctgacagtactcagttttttcagcactattgatttaaaggatgattatctctttaatgataataaggagactacataaatagtgtccatatatactgtggacctacttttggacatctagttttgcattggtgtagccatctgtctttgtgtaatcctatcttttcttgactactttaatctagttttattaggttatagagttaatcttcacatttcatcagaagaattttgca

SEQ ID NO: 791 - DNA, 707 bp, Homo sapiens
  misc_feature: Incyte ID No: 110049.1
gttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtgg

SEQ ID NO: 792 - DNA, 3902 bp, Homo sapiens
  misc_feature: Incyte ID No: 1806212CB1
ggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatacccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctgttctttgggtgtccaagaaaaaaaaaaaaaaa

SEQ ID NO: 793 - protein, 1176 aa, Homo sapiens
  misc_feature: Incyte ID No: 1806212CD1
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 794 - DNA, 1477 bp, Homo sapiens
  misc_feature: Incyte ID No: 4436028CB1
ccagagcccccctccctttcctccccaccccctcccctccccaaccctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaaaaaaaaaa

SEQ ID NO: 795 - protein, 375 aa, Homo sapiens
  misc_feature: Incyte ID No: 4436028CD1
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 796 - DNA, 790 bp, Homo sapiens
  misc_feature: Incyte ID No: 406663.3
ggcaccgccaggcagatgttggtgccattcaatggtggcagtgccagcctgggcagtcgcagaccctccaaagtagaggtgtgcctgacagttggctttggagctagtctgaaattgatggacttgctataagatattaacaagtgatttaaaactctgttccagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccacgtca

SEQ ID NO: 797 - DNA, 846 bp, Homo sapiens
  misc_feature: Incyte ID No: 405689.1
  unsure 196, 817, 828, 833: a, t, c, g, or other
ttctatgactatctgggtttccaggccatgttgcttggtggcggggagggctctagagatccctgcagggagctgctaactacagaggagcctcctcccctggtgacagcctctgtgctttcagagattctaggaggaaatcctctcctccccttccctgccatgccagagctgtcaccctcctgctgctgctctntttgctgttgctgctgctgccaagccagcagccgccgccgctccccacccccacttcccaacccagtgctggctgccaagaagccaggtcacacagctgtgcacgtgagccgggccctcaggaggagaggctgggtgtggagatcctcctcctgctgcgtgccagaggagagggaggcatagcagaggcagcagccgaccatatatctccactaacgtggggagagcaaactgagaaatgaactcacccagccagatgggccttgcgtaagctacttcttggccaagaagagccccgggaatgtggctccataccatcccaattcatccttatataaacagcctccgttctcttcttcgccctctgatactccttccttcttgcatgagtgcagttatgttttccctggtcatgaaaaatactttgtaaactacaagactctctttaagtatcagttgtggctatgaactctagctccagtctctgaatttgggaggataagctgtcttccacctctctgttcaatgttctaataaatggaggctaagaaggggatgattttccaagaaaggaacatgtctgctattccttatgatgttagagttaaaaaaaaaaaaaaangggcgccccgnctagngagctcgcgcccg

SEQ ID NO: 798 - DNA, 215 bp, Homo sapiens
  misc_feature: Incyte ID No: 110815.1
gccagctaatactgctgttggtatagacatggaacaactgaacacttaggcgttgcagatgctaatgtaagtaggtacattcactttgggaaataatttcacattattaaagttgaagatacacataacactatgacccagtattcctatgtcttagagaaatctctatacagacataccaggtaatgtatgtagttgtttatacagtactgatc

SEQ ID NO: 799 - DNA, 4282 bp, Homo sapiens
  misc_feature: Incyte ID No: 1385527.4
gccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagattacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattatttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatccagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgaaaaaaaaa

SEQ ID NO: 800 - DNA, 166 bp, Homo sapiens
  misc_feature: Incyte ID No: 002570.1
agtaaaatgttttaaaacatttggagtcctcattactaatagagaaagaaggaaagtttctatttacaggtaacatgattgttatgcttgtcaggcaagaatatgagaagtaataagagtacagcaagttttctggatctatgatcaggcaaaggccgggagcggt

SEQ ID NO: 801 - DNA, 1049 bp, Homo sapiens
  misc_feature: Incyte ID No: 1100724.1
  unsure 113, 164, 167, 171, 175, 346, 845: a, t, c, g, or other
agtgccaggaccagctgggttcactgatgtgtttttgagatacttaaggtagaaatgataccaagtctctaccatctctttcagaaaataaaagcagagataacacttcccanctcattgtgaggccagtattaccctaatagcaaaaccaggcaaagatattnacnaganaggnaaactacagatcaatatttccattgaacacagatgcagaaatccttaaaatgttagcaaatcaggaatgcaagccttgttaaacatttgatattcagtgcaatccattgcatgcattagcagttcaaagattaaataggatcatatcaataggtacagaaaaagcatttgncaaaatccaatatccattcatgataaaacctctcaacacagaaggaatacaggagaacttactcaatttgataaagaactactacaaaaaaccctacatctagcatcatccttgatgtttccaactagaacactttcctactaagatcaggaacatggcaaggaacaccacaccactgcttttcagcattgtactggaagtgctatataatgcagtgataccaaaaaaaaaggaaataaaatgcacataaatttggaaggaggaaatacaactgtctttgttctcaaataacatgattgtctttgtaggagaattctaaataacaaaaaccctgcgtgacattaataagcaattaccagcaggattgcaggatacagttcctcaggtagatgataaaaaggaattggacatcaagtcattaaaagacacggagaaaccctaaatgcttattgttaagtgaaaaccaatctgaaaaggctttctatgttgtatgattgcnattatatgacattttgggagaggcaaaactattgagccagtgaaaggaccagtggttgctgagagttgaggggaaaggagggatggcaggtagagaggtgatttttaggacagtgaaagtactctgtagggtactgtaatttgtcaaaatgcagagaatggaaaacagtgaacggaaaacacagagtaaaccctaatgtcaact

SEQ ID NO: 802 - DNA, 706 bp, Homo sapiens
  misc_feature: Incyte ID No: 3704760CB1
gccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagagcaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgaaaaaaaaaaaa

SEQ ID NO: 803 - protein, 172 aa, Homo sapiens
  misc_feature: Incyte ID No: 3704760CD1
MPDSWDKDVYPEPPRRTPVQPNPIVYMMKAFDLIVDRPVTLVREFIERQHAKSRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 804 - DNA, 2288 bp, Homo sapiens
  misc_feature: Incyte ID No: 344017.6
gcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaataaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaattaaccatctataccacttgtttctaaggcactgcctattccagcactttc

SEQ ID NO: 805 - DNA, 2094 bp, Homo sapiens
  misc_feature: Incyte ID No: 344017.3
  unsure 38: a, t, c, g, or other
agaaggtttggaacaaatgtagatttttaaaaaatgcnacataaaatgagtagactccctatacttttcgcaaggtctatatatattttaaaagttcaccttctatacctgtgtcccctgtattaaggcatttaatgtatttaatgagtattaaattagtttcagattcaggttctaaagcaaaatattagtttgagtgctgtgagggttaaatgttgtggtttgattatcacacgtttttttatttgtgtggaaaacttgagatgaaaccatcttttagaagtaatttactgttgcatagttttaaaaactaggttttattagtaaactcaaaagtgttcatttattcccatttctcctcagataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatc

SEQ ID NO: 806 - DNA, 1388 bp, Homo sapiens
  misc_feature: Incyte ID No: 2770104CB1
  unsure 150: a, t, c, g, or other
caggaaggagcagacacaagaagcaccagttctatttgctgctacatcccggctctcggtgagacgaggagaaaccagacagacagtggctgggggtcaggaaagaccccattacagtctgaaatgtctgcagagggcccagtgcatgcncccacctcagctctaaaagaatgagagtcaggctcctgggagggcagttccgcttcttgtgtggctgcagatgacaacaccccatgagaaggacccagcctctgagtgtccacacagggtgggaaggaggggaggctatttctctctgtgtgtctctgtcccgccagcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggttgctggtgatgacaggagctaccaaaacccaacctctcagcccagcccaggccctgtggtgaccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaaaaaaaaaa

SEQ ID NO: 807 - protein, 310 aa, Homo sapiens
  misc_feature: Incyte ID No: 2770104CD1
MRRTQPLSVHTGWEGGEAISLCVSLSRQHRGLIHPQSRAVGGDAMTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVAGDDRSYQNPTSQPSPGPVVTPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 808 - DNA, 934 bp, Homo sapiens
  misc_feature: Incyte ID No: 349204.1
caggaagagggcacaggccaagcaggggtgtgaactgcgagagcatgaagcagttgctggagcaggagctgaggcctccttatggatgaatgggaggtgcgtttggaagcaagatgccactattggagtgacgtgggccttgaatgccagactgagcattgccagccagacggaatatcaccatcatcgtaatctaatcatagtcatccagttgtgaggtcatctgatactggcaatgggtacacaaaatattaaataggatatttatttctaagccaagtttcagaaaacaatttacaaactttttttaaagtataaacatagtgtatgcttactataaaaggaaaagtataaaacattactcaagtatatatagaaaatgagtgggctgctgatccccctctatattatctattgctgtgtgacagtattaccacaaatacagtagctgaaacaacacatttgttttctcacagtttctgtgggtgaggagttcaagcatagcttggtcctctgcaagcttacaatccaagggttggctcaggctgtattctcatctgagcactctactggggagggtttcaggcttacctgatggttggcggcattcagtccttctagactgtcagactgagggccttggtttttgctggtgcactcagttccttgcttcatatagagtagctcacaatgtagcagcttgtttcactaagacagcaaggaagagtgtttcctagtaagacagacactgtagtcttacctaatacaatcatgaaagtgacatactgtctccttcgccatattctgttagagacaggttacagctttgcccagtggcagtatcctagccaatgaggtttatctgaggcatgattattaaaataattgaaaattttcccaatacaccaaagtgacaacttacaacataggttgg

SEQ ID NO: 809 - DNA, 1652 bp, Homo sapiens
  misc_feature: Incyte ID No: 2641740CB1
cttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaagtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagagccagagagctggatatggggtcggggatcgggagttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggt

SEQ ID NO: 810 - protein, 416 aa, Homo sapiens
  misc_feature: Incyte ID No: 2641740CD1
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 811 - DNA, 826 bp, Homo sapiens
  misc_feature: Incyte ID No: 211881.1
cttaaaacctgacatccttcatgttagctaacctttataatctctttggatgtagtaaatttttagtattttttagattgaatttgtatcatatttgctagcaaattgagtataaagagtagcatatttttactacagatgtattattttaactaacaaaggcatattatacatttttttcatatataaactttggaataggattttacagtaacttaagttttttatttctacccatgtgtcaaagttttatgctaaattctgaatagaatagttgtaactcccactctgggtattttatttattttaaacagttctagtattgtttcctgtgaattttttccagggattgctactttctgcactattcattagaccaagagcatttcaccaaatacttaaaacttaaaaatttttaaacttttccaaatttgattaaaaggataacatattctaaaggtattcaatatttttacttatctctgaaaaacttaatcacataaaagcatacattttacacatacagctctctccatcttccacaatagattaagacataaaacataaccagtatttttgaaaagcccccttaactggcatgcttcttactgaaattatcataaaaggttcgtatgagaaaggattccagaatatcccttaattgtgttgtagcttatgcatttctatttattttatacattatttaattcatgtgagttacttacctggcagggaagatatgatcaccaaggtgcctttcacattcattgcactctggatgtgctgacccctgcaatttccccaaatgggggaagctcaactgcat

SEQ ID NO: 812 - DNA, 634 bp, Homo sapiens
  misc_feature: Incyte ID No: 334749.1
gacgcccatcaatgaacaaacaagattcccactgtcccatctcctatccagtgaaacacagccaacttgataatttgtgcagggaaagactctgtttagcttataccttgaacctaagggaaattaaattgcacattttctgttcctggctaatcttctgaataatgtactgaacacagtaggagttaagaattaaaaatacctgtctgcagtttcagaaacaatcacacacaaaatatttgtttatttccagactgatgaaagactgaatttttggtctcatgtatttactgtattgtttcatatatttatctatatgctttggctgtattaacttgttgaaatagtttgtggttctttatatttagcttttataaataattgaaaatctaatgaatgcttacttaataaccaatctaaactggggacttcaaacatagggagtcaagtaatctggttgtgtaataaataagcaagttgttatctttcaggctgagggcatatcaaccaagctaaaagacgtgtgtgtattaaaaaaaaaaaaaagtctaccaaaccaccatatgatatccaaggttaactatataggaggtctaataacattcagaaggtgctagatgaatataccaaaaac

SEQ ID NO: 813 - DNA, 997 bp, Homo sapiens
  misc_feature: Incyte ID No: 407838.1
  unsure 740, 746, 819: a, t, c, g, or other
atttaatatctcattcaaacacaataaataaataagaagggaacaaatgcaattacataaaaatcacactgtcattataactaaaaaaaatctaaattttaaattatctatgggtaaaaaaaaaatcaagcaaacagaaatattcaagaacaccaacaaactccagcaagctacctccatggaacaggggagagggcaactagcaatgcctaaaattaatgctgaaccatcagccaagaatggaagattattcaacttgtgaaaataaagattgcaggggtcaaattgataaagtataagggcgtgttggatgaaaaggtagtctcctaggagtggaggaacacagtgaaaggagttgatggaaatggaaaagcattctttcgaagcacaaggatgaattgcaaaagagcaagtggaaaaaaacaagattttcaaggcaaaagaaaatttaaaaaattaaaagcgtacaacctggtccccacttcctcactcctcctaagaaaaatctaatacagaattatatgctttgttacagagacagaagtgagtgatttttaaaccaagatccttataaaaccacagattgtcagtcttgtcaataaaaattcagaatatcaaacactcttttctgaaaatgttgacaaagttaaatgaaaaatataaagttatacaatttagctggcaaaaaagcccttccctcacccccccaaaaaccatggcacttggtcaagcagaagaanactganatatagcagtataaattgaattgcaaatcttaaaccagtgtttatggatctgaaaaatcatcttgaatcaganataaaaaatctaaaatataatgttaataacaggaagaaataaaatttattgagtcaagaaaataaatagaagggatgttaaaatcatattagaaataattatgaagttacaaagtgacctagagagaataaatttgaatgagaaaccttaaactaaggctagatatagatagacaggc

SEQ ID NO: 814 - DNA, 1299 bp, Homo sapiens
  misc_feature: Incyte ID No: 170915CB1
cgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctccgctccctccggggtggcgcgcccgggggaggggggagttgggggctggatagcttcccagcaccctcagagcccccgcccggctgtgccccgtctgaccaaagttataataaaaacattttcaccccgcaaaaaaaaaaaaaaa

SEQ ID NO: 815 - protein, 258 aa, Homo sapiens
  misc_feature: Incyte ID No: 170915CD1
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 816 - DNA, 509 bp, Homo sapiens
  misc_feature: Incyte ID No: 994387.88
agctcttggacttctgaggctgtttcctaatttcaaaattaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggaacaacgagaacaagagcacactgcagttggagcagcaagtaaaggagctgaagaagtcaggtggagctgaagagccaagaggctccgagtctgcagcagcagccagaccagtagctggagc

SEQ ID NO: 817 - DNA, 1704 bp, Homo sapiens
  misc_feature: Incyte ID No: 2454013CB1
cgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattaaaaaaaaaaaa

SEQ ID NO: 818 - protein, 323 aa, Homo sapiens
  misc_feature: Incyte ID No: 2454013CD1
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 819 - DNA, 1052 bp, Homo sapiens
  misc_feature: Incyte ID No: 427967.6
atttttcagtgcttttaagaatatgtttttaaaatcttttatctcagtgcttttcaaactttaatgtgcaactgaagtcacctggtcatcttgtgaaaatgcagcttctaattctgtaggcttgagatgggacccaatattctgcacatctaacaacctcttagagagtgtggacgctgcagatgcacaagccacagtttgatcagcagggttttatttcatatttttagttatttttagtgagtaagttggctcaaaggacctggaagaccattgttactcgactctaaaattacctgaataaagtgctttattatgtgtcagctatcagcatttttataatctcaacagccatttgaagtagctgcaattatttaaagttatagatttcaaattgacctaatgaaaacactgtgatgctacatgtatttttcttatttttagtattgagttgattattgaagcaatgatgagcttcacggtgcctgaactttatttattttactagagtatgtaagttttaaaaatactatgtattttcatatagtaagccatgttagtttatctttgtgatctctctcagtctttatattttatattgttagaaaatgtgtacatttcgttggtaaaattatataacttttgaaccttcaaatgaatattttgaaagtagagttggtcacagtagaaaagatttcctttcacaagattattagtcttttcaaacaacaataataaattgatacttttaagaagtttaggagttgtgaatgtggtaaaactgaacctttccagtgatttagtggaaaggtcttatcaatcttaattttttctttttcatgaaagtttctgcatttgtataaatcatcaatattttctgttctagggaggtgttgtagcaggaaatgtggctcatattctggactcaaatcatggaaagaaggcattactgtacactgcggtaaatcagttggcatgggaagcagttcagcagaagatgaaaaaaatactgcactaaagaccattcagaaggcagctctcctttctccagg

SEQ ID NO: 820 - DNA, 5712 bp, Homo sapiens
  misc_feature: Incyte ID No: 427967.4
gggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttgggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagcaaaaaaaaacaaac

SEQ ID NO: 821 - DNA, 490 bp, Homo sapiens
  misc_feature: Incyte ID No: 257016.1
accactgagactgccgtccgcacagccaagaaaaaaatggtcccaccatactcaagtcaagaaaacatcttcctcgtcagaatcatgggttactgtactaggattaagccctactaagttaaagttaaagaaagcttaattttcatataccttctatattgcttcttttcctttccttattctgttactagctcctttgttattaatgtaactaagtctgagtcacctcagaccattgccttttatgcttgctctgtcataccttgtggaaatgtaaaagatcaatgacagctagccttttcacacaattatttatgcctcggccctctaattgacacagttacccctagcactcatcgttgtgatcacctgcagccaagacgctgattttctgctcctatagcctggcaaccttgtggtacatgggactacctcctttaaactacccaggagcaaagttggacttccatgaaaaaggtttgtgcagatc

SEQ ID NO: 822 - DNA, 1567 bp, Homo sapiens
  misc_feature: Incyte ID No: 215158.5
  unsure 582-583: a, t, c, g, or other
acaaacaagatcagcagccagtgtgggatgttgctcaatggggctccacttcccactagagtgtaagctgcttccacgcatgctactgcgtgctccgagccatcgcagcggagtctcttctcacccagctttgatggtggggcgactcccgtgtctgcagctgtggtccaaagggtgtctgtgctggatacagaagttgccgtgacattgggcacataccatctgcagcatctctttcttcttgcagccctcttttgagcaacggtatgtaaaaatctaagagagcaaagtgacttctctttcttcttcccagggtgagagtcacagtctctgtcaatgtgatcaccaaccaccacgtctggtatctggcccttttttactgggatgggggtattacagagtgggcatactgggacgtgcacatccttctggaatgcaaacggacacttatgtgcagcgtatggaaaatgatctttacagaaatcttgtttacatgcatcacattttactggaagaaaatctagctgcttgcaagtcttttctgaacaatgcttccccaaatcaggaaactccattatgagnncagtgctcaaaacgcagatggcggagttaagtgtcacctggctctcgtcggggacccaggcagctgaggcgagcagcagatggaagagacgtaaactcaggtgtcctcctccgtagtcggctccgggtagctaagcagaaagaacctcgacactggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttgaaaaaaaa

SEQ ID NO: 823 - DNA, 676 bp, Homo sapiens
  misc_feature: Incyte ID No: 000522.12
actgggtggacggcatgggttggtctcaggatttgttccgcgccttgtggagatcgctgtcaagggaagtgaaagagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttccaaagtatggagcagaggcatggcctttaatttgagtttgaactggtggaggcaggagttcctcactggtctctttactaaggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtg

SEQ ID NO: 824 - DNA, 503 bp, Homo sapiens
  misc_feature: Incyte ID No: 000522.10
gggaagtgaaagagcacgtgggcacggaccaattcgggaacaaatactactacatcccgcagtacaagaactggagaggtgaggtggcggcgtgggcagcgattgcgtggtcagtgattgcgagaacaaactattcgaaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataacaagaagtgaaaagttcaacaaaaaaaaaaagg

SEQ ID NO: 825 - DNA, 444 bp, Homo sapiens
  misc_feature: Incyte ID No: 113633.1
gccatgagattggtcccaggggccaagatctaatagagcgagatgtgaagaaggaatcctggaccttcatgattcagccctaaaataatcagaactctccctccattccacttttgtgccagtgtgtttaaaagcagcagtctattaaagcaaaaccatatgtcatttagggaggattcaactttttactttcatttctttgttttaaggcaaatagattatttctctgccagagtcacagaaaccaaaatccagctataatcattactcctattgtgatgtggactgaccaagacaaggctcttttctcttactgcaggtgggagtataaattggcgccacctttctgggagggcattcgtacattcattcaaacaattatttgctaagtacctaactatgtaataagaccctagtactaggagcttaaaaccaaatatgtat

SEQ ID NO: 826 - DNA, 439 bp, Homo sapiens
  misc_feature: Incyte ID No: 477387.3
ctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatatagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaattgtaacattaaattttgcccatgatttttggcatattgcaaaggaaatataatggaacccagttatgatg

SEQ ID NO: 827 - DNA, 1985 bp, Homo sapiens
  misc_feature: Incyte ID No: 477387.7
ccggacctcagcgtctcccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtggg

SEQ ID NO: 828 - DNA, 4457 bp, Homo sapiens
  misc_feature: Incyte ID No: 347796.7
ccgtggcttcagccttggcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaaatacaacaattctgaaactcttaagagaaccagaattggaaggaaaggagaatggccaaaattatattctcacaacctaaagcagtaaactttaaaaataggttcagtcttagacttgacttaattgactta

SEQ ID NO: 829 - DNA, 600 bp, Homo sapiens
  misc_feature: Incyte ID No: 2656429CB1
ggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaaaaaaaaaa

SEQ ID NO: 830 - protein, 146 aa, Homo sapiens
  misc_feature: Incyte ID No: 2656429CD1
MESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 831 - DNA, 1744 bp, Homo sapiens
  misc_feature: Incyte ID No: 3346307CB1
ccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattccagtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaaa

SEQ ID NO: 832 - protein, 232 aa, Homo sapiens
  misc_feature: Incyte ID No: 3346307CD1
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 833 - DNA, 1065 bp, Homo sapiens
  misc_feature: Incyte ID No: 2649071CB1
ggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgataaaagaaaagagtaaaaaaaaaaaaaaaaaaaaaaaaaaaaaaaaaaaaaataaaaaaaaaaaaaaa

SEQ ID NO: 834 - protein, 281 aa, Homo sapiens
  misc_feature: Incyte ID No: 2649071CD1
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 835 - DNA, 1200 bp, Homo sapiens
  misc_feature: Incyte ID No: 1383086.2
  unsure 11, 33, 40, 64, 70, 85, 102, 133, 155: a, t, c, g, or other
gtgtgttaggntgatttttccctttattagganttcattnttttattattcatttaattgcctncttagntccctgggatccccnccttggagctaggagantgaactttcttcagggagctctaccaaaganagaagaccactgtgtcttctcntaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaa

SEQ ID NO: 836 - DNA, 2095 bp, Homo sapiens
  misc_feature: Incyte ID No: 1850670CB1
  unsure 16: a, t, c, g, or other
gttcaaaagtacaaangctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcataaaaaaaaaa

SEQ ID NO: 837 - protein, 583 aa, Homo sapiens
  misc_feature: Incyte ID No: 1850670CD1
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 838 - DNA, 1816 bp, Homo sapiens
  misc_feature: Incyte ID No: 1132386.3
gtttctctagctcatgaatctttttttccagggtagactgtctttgaattgcttcttctttttctttgaccatttttcttaatgtgtgaacttgagtatttgcatctttgtgagatttcccggacgacatccagctccttgttcctctgcatgagttgcttttccagttcccacaatcttggacatggcttcatttctctgtgtcttgcagtttttcagataaatgagaaatgttttcttccagttcttccaccctctccaaggcagcattcttagtttcagcatcttcccagtagagctcctacatcaaaaacattgtccaggtaagcctggatctggacttgaagcttgtcactctcagtgtgtttcagcttgtccaagtattcgtccaggcctaatttggtaaattcatactgcaggtgaactctgaaattcatatcttctactgaatggactacaatattaataaaccggattagaagccaccataaaatctatgtcattgtcttcattcctgaaatgtgccatcaacttctcaaagcgctgtttttctccacaaacctctttaaagttatcaaatgctgataaaatgatttcatgcccgcctctgacaagacaaacggctgccaacagttctaagacaagggcttttgttctgggattcttgttgttcaggcttagtgcaatctcattgacagcgtgtggatgagacatgaccatgttgaaaccagactgataattcatgatggcacgtaaacacatgttacagacatgcacatcatctttcttactcactaatcttgaatttttgagagttcttctgcttggcaatgtattatatcgcagtgcagaatgtcttccagagcgggagacacttgttgcccacaggtgagggcaggttgctccctctgtgcaggtcctcgatggacctactccagggctttgatttgtccaccgagctctccacagtactctccacactttcaaagtcaaaagttaccgcgtactgtgcaaatgagagatattccactacgaacatcaagacctttgttttcttcattcagaaattctctgacccatccaatgtggttagttctcaaagaaatttccagttctcttagcacttgtgtagatttcttgaacacgccgtctgaatttcttcctggttacagctggatccagatagcctttgagcttttgaatgtactgtatggggaggattcttcacctggaatcgttcctgatcacaaatcagttcccattttttctcattatcatactgccgcagtaacctggctttgtcaggaggtaggttcatagcattcagcacgatggcaaatcgctcctccagttcacctggctctggcatcggcagcttcaaaggcacggttgtgcgccctgaaatccgttctgctgcgaatccaatgctccctgcgttgcccatgtcggcggcgcgccggggccgggggctgctccgggcccctagcgtgcgcgtcggaaatcagaacagctcccggcggtcggctgccgcccgcaggcgcgacctgcccggctcccccgcccttcggccgcgcccaggcgggtgtgcggcgcgcaccgttccctagcagcgctccaagccgagccgccccccggcctccctcatgctctccgccgccccagcgcggccccggcctcttttcctcgggaggggtagtcggggcgctgggcgcctatgtgcatggtgctccgcttggcacaccgcccccttgccagagatcgcggcccccggcgcgtggtccctcctactcggcctttctgccgggcccgcggccgc

SEQ ID NO: 839 - DNA, 576 bp, Homo sapiens
  misc_feature: Incyte ID No: 115052.1
  unsure 329, 391, 471-472: a, t, c, g, or other
caaaattcagatccatgaagggtcaagattctgatgtgggtttagaagcccataggtcctaaggaactcagtcttctttggcatataattcagagtatgatgaggcctggagtcacaaatacaaatgtgcacagcagccaggagcaggtaatctatacgaggaagctgacccctgtaagacaatagagagtggtggggactgtggcaagctgaagagcacatgtctcatcgaaagcatgcagtgtctgtttcctcacctcctgtggatcatagctatgtgggaatatggaccctgttaccacatcctcaattattttattgaaaagacnagatatcctgaacttaaggtaaaatcttcaaacattttaaagcaatagacggaacaaagggnccatttctgaggaccaaatccaacctctgggtcacaagtgcaacctttgacccacaccgtgcttcccagcttccccatcnncttcatctgacatccaaaacactcaaacagttgactaatctccaacaggtgcacatgggttataacaaaatcccaactctacgacaacctcaaatctaatgtga

SEQ ID NO: 840 - DNA, 1965 bp, Homo sapiens
  misc_feature: Incyte ID No: 1330056CB1
  unsure 1783, 1953: a, t, c, g, or other
cggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgatcattttaaaaacgaactaaactaagtagttcaacaagtgaaggaattattactaaagaatcctccaggggggccccgttccccaattggccctatggtgggtcgttttccatttcactggccggcgttttacaacgtcgggcctgggaaaccccgggggtaacccagcttagtcgccttgaggaacatccccatttggccagttggggtattggcgcagaggcccagaccgttcgcccttccgaacattgggcagctanattgggcgttggacaattgatagcgtaaatgttttgtaactattcgggtataatttttgtatactgagctcatttctttaacaattaggccgacattgccaaattgcattaataattcaaagggctaggcccaggaagggttttggctttggttcaagttgggaacaggngtccaatctttg

SEQ ID NO: 841 - protein, 445 aa, Homo sapiens
  misc_feature: Incyte ID No: 1330056CD1
MAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 842 - DNA, 2894 bp, Homo sapiens
  misc_feature: Incyte ID No: 199788.2
agccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaagaactcgtgtacaactacattga

SEQ ID NO: 843 - DNA, 866 bp, Homo sapiens
  misc_feature: Incyte ID No: 027881.1
ctttatttacatcatgaagtttaagtatgtttctcaggaattttcttctttaacatcataaataaagaaaaactcaaaaaaaatgatttcatcatgccttctatgttaattactctttcttgtattttacatctttccagtaaatttcagttcctaaattcacacacagttccacataggaagctaaagaggcataatccagattaagaaccaaaaatgaaacagaaataggatacagttgaatcatctgtgtaacaaataaagaaaaagcctgggaactataaagctatggaaaatgaaagaggctcactgagatgaaccagagtgtacaaatgctgaattcaatacagtgccaagtatttagagtgtttttttgcattgaggttattgtggctgtgaacaaggattaccatccacagctagaagagaaatcccccgggacagaatctctaaaacagggtcctcagttacataactagcgatttatgaaatgtgcttatattgtatgtgatgtcatgacatcatttcttggtcttctgctcagaattaggtagtttgactataaaatctactatttggggacacatttgctgctctgcaaggttactgttaccattgctgcagtcaagtggcatatacttaagggactggagtcctgaaggtctgtgttgattctgggaggtgtgcacatatgtgggtccagtgttctttacaaaggccccctgtgcggcatctgtcgtacttcttatttgttcagcatatcccttggcttgtgatggaagatacacaatctgtacctttgtctgaaggagataccagctcctgagtggccttttacatcatccttaggtggggatagttaactt

SEQ ID NO: 844 - DNA, 3427 bp, Homo sapiens
  misc_feature: Incyte ID No: 234543.1
gaaggagggtaggcgcaggacagagaggagagggaaaacagaaaaaaattgtgtgccactatgtctgaatatatcttctacttgtagataattacatccaagttgcccttttgcctttttatttccgtttttggacacctctttttatcatccagccaactggaatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggttttttttggttttttttttttttttggtttttgcttttttttttttttggttatctatagtttagctgaaaacaaaatcaaagcagttaagtctgtaactttctttttgcagctaaaacaacagaatttgctgctctccctcccctttcctgcaatttaattccttacagattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggcttgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctcttttttttctctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattgtgttattgttttattgaacacaaatattcatataatatgtttggtttgggggttttttgtggctttttttgagacggacaaacaaaaaataaaaaacaaaaaacgagtttttttccacggtttccagtttgagtctgaaaacagtttctt

SEQ ID NO: 845 - DNA, 588 bp, Homo sapiens
  misc_feature: Incyte ID No: 231547.2
gcggcatggcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgctgagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagct

SEQ ID NO: 846 - DNA, 866 bp, Homo sapiens
  misc_feature: Incyte ID No: 399785.1
  unsure 18: a, t, c, g, or other
acgagacgagcacccgtngggggctggagcaccccgcgcgctcccctggcgagagggagggtcgtggctcggcccctgctcagacaaaggctgggaggcgggagacatgcacttccccttccttttcagccaggcgcgcgctgataccaggcccacgtcagctatttttggagccttttacacgacagctggaggagcgtcctttttaattttccccttttgtttggccgcccccacccccaccccttcgccttcatcgctgcacttgaggctccatcctggggcctctccttgacttgacctgccttggcaggcacatgccctccctgcctggctcactcgccgcagagacctggcagcccgcgcaaaatgtcactttgcggaatcgttcccacggcttctgggtacccttagttccctgcttagggagggaagacagtagtcgggtcgtaataagcaagacttagcccgagcctccgttgccaacgcaggctgccttgcttggcgtgtgggcatcggcctgccccctcaccctggctacccaacacagctacaaaaggcagggaacaatgtaggtcccttggccctgcctaatgcctgttgccatggaaacccctatcctaatctggccaggagccccttgcagtgagccaggagagtgaggaagaggggatggggcccgctggcctgaacctggccagaggaggtaatggttaaccggattgtgggagcagctgactagagccgggggggtagggaggcttgggccccagtcctaccttccctgccaaggagaaaggggcatgtctgcttttgtacctctgggaatctacctcagggatctgcccaacaactcccaggttcca

SEQ ID NO: 847 - DNA, 4855 bp, Homo sapiens
  misc_feature: Incyte ID No: 010498.24
  unsure 3259, 4828: a, t, c, g, or other
ggaggctgagagcagcagtagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgactccttccccaacaaactcccattctttcatgaggcggcaaactcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggccagcatgctcatggcaatctgtttggggctgttttgttgtggcactagccaaacataaaggggcttaagtcagcctgcatacagaggatcggggagagaaggggcctgtgttctcagcctcctgagtacttaccagagtttaattttnttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaatcnaagagtgcagacttataattttcaaaa

SEQ ID NO: 848 - DNA, 1121 bp, Homo sapiens
  misc_feature: Incyte ID No: 399161.1
  unsure 1070: a, t, c, g, or other
caggcgggagcaccgtgcctggcccagatggatttttaaatatcacctgttcatattgtttaaaatagatacaactaaaacagctttgaggcatacaggaactctacagataaggaggaccatttcataatgataaagggcttatctcaccaagaaggcagtcacacttacgtttttatgtatttgttgaagagtcccaatgtatttaaagcaaaaataagcaactacaaagagaaagatacaaatccatgatcaaagtgaggaattttcacacacatcgtagtaactgatggaatgagtcaatgaaaaattagtgaggaaatagaagatttggacagcacaacaaatggcctaggagaacatttagaatgttgccttcgatgcttaagaatacatattcttttcaaaagaaaacccagaacagcctggcaggagagataccatcatcatgaaggtgattttcccagagctgggcttatccattgcattctggatgtgctgacgcctgtggttttcccaaatgtgggaaactggactgcataatttgtggtagtgggggactatgttcgtgttctctcctggtgtttaaaattaaaaaaaaaaaaactttattaaaggcacagaacattaataaaaattgacaataaactgggctattaagtaaattgcaacaatttccagaggtttgaaatgatacagagtatgttttctgaccacagtacagttaaactaggaatataacaaaaagataactagggatatgtgtggatattgcatacctctaagtaacccttgggatgagaaagaaattacaatggaaattagaaaatatcttgaataatgaaaatacaatatatgtaagcttgtagaattcagcttattaaatgcatattttagaaagaaggaaaggctgaaaatcagtgagcaaagccttccatctcaagaaatagaaaaagaatatagaaggaaggaattaatatttttaaagaagcactaatttacaagaataattaaatagaaaagaagttgtcattaggaaggatcaataaagctagaagcttgttatttgnaaagacttgtaaatgtggtaaatcacaagtaacgtacgtagatgaaaaggg

SEQ ID NO: 849 - DNA, 538 bp, Homo sapiens
  misc_feature: Incyte ID No: 241467.1
cttacactcaatacctaaatttaacaattttttgctacatttgcttcatctagacccttccttttttttttgctagagtattttatagctaatctcggaactcctatcattttgtcagaggtattggaaccagaggactccatcttgagtgagggctacgaaaatgaggctggggcttgctgggctgcattcccagaaaggtattcctagcctctagatgtttaccgttaagggaacatactgatgtttactaaacagacccagacttgagagagtcctaatatcccgatatctggagaacaaaggcattcctaattttgctttgaagataataatattgattcttgaaaaatgtagtaattaagaaaattaatcctttatcacaaacccttgtagcagagcacatcttcccatatatacaagcattgtaactagggcagacgcgttcctccttactttggggaacatcctactctgtctatggagcagctgttgtttcaccacttttctctcttaataaaacttgcttttactttgc

SEQ ID NO: 850 - DNA, 1609 bp, Homo sapiens
  misc_feature: Incyte ID No: 997194.1
cccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcacgtggagcgggacaacgcggagctggagaaactcatccaggagcggtctcagcagcaggagcccttgctgtgccccagctaccagtcctacttcaagaccattgaggagctccagcagaagattctgtgtgccaagtctgagaatgccaggctggtggtgaacattgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagac

SEQ ID NO: 851 - DNA, 1590 bp, Homo sapiens
  misc_feature: Incyte ID No: 017819.1
tgcaggtcttggagggtggtggcccactctttctgggccaagtagagggtggctcagacaccccccccttcctccaggcttctcatctgtaactggtgaaagcccgggaagagcttgtcgttcaagaggaaatcttgtgttacttctttatgaaggactccagcctggtggagatgaatgagtcctgaagatggaatcgaagctgtttgggcacaatactttaatcagcatttaatgacccagtcgaaaattcattgtttggacccaagcactggtgggaaaggcaggaggggaggcctgccttccttcctccctcccgagccctacagcaggccatggagtggtgagcgagttcgtacagtgccaaccacattcccagaaacttccagcagaggttaatcctgctcctctcaggaaaaagtgattcagctccggtccaccctgggtgcagcggtccttctggcaaggatgccttcatatcatacagctattattttcgggaggattccaagtgagggcagtcagggtgggcttggcccattctctagactttggaaggtaagtgtctctatagaggcctgttctgaagctttaccaggtcaaaccggagaagaacccaacaagtaactcatcccagcctaactattcttcaagggcaatcaacctacagcatccaagcacagagaaatcaaatccatggagaatcttcaaattaggctcagaatccatttgggtcaatgaatttactgttattaagattttaattgtggtccacccaatggattggacataccttagagtgagaagatattcttcctggcctcagactagttgaaggtagagagagagacaggcccttgggtgtggggagacctctcctgggataatacacacaaaaaaccaagagctgctcactgtggtgcaggagacagcagggcctgaagccagaggctctgtgtccttgaatacaatgttttactcctctgacccctgttactgtgatttggagaggcagacaatataggatgggctttgcaggcagggaggtccagttataatcccagctcttactaagttgggtaagactcactctgagacttagtttcttctgtcatctctcaatagaatcataaaggtactttcctcttagtgttgttttaaaattcagtaaaataatgcaggcttagcacagggtctgatgtaaattttcaatgaattatcgttgtcaatattgttctggaaaacaagagggcatattagaagatcaaaagtactgccaagcattgaagtgccaattctagatccagtctcagccctctgagaatggatatcattgttttcaagccattcagaaaccaatgtgaattgaacacctagtatgagctctctgagggaagagccaagtcatgcattttttatcttaaggggtcttcaatacctctagcccaaaacagtatctccatcaggattcttctctgatagtgttcatttcttttttctcaatggatgccttaaaaaaaaaaatcctacaaggaaacctgtactcctcaaatacaccactcaggtgaccattaaatcatttacattgtt

SEQ ID NO: 852 - DNA, 1409 bp, Homo sapiens
  misc_feature: Incyte ID No: 116536.1
agcacccctctcccacctcttctggtaacagacccagttcctttagctgcttagggggaacatgtcatagtgaatgggccaatccacataattcctagaggaacttttcaatccttgtgggttgggagatgcctatctactcaggtcacaagcttcggggaagtacacgttgctgatggccacatccccacctttatggagagtgagcaggtctgggaagacggcatcagacaggagcacaaaggagagggagggagtcctgagggtgttttcaggtccctcagtccaccatccttcgttatggttcagttacatgaacaaatacatttccctttcaggcttaagctagtttaagatgtatttcttctattggcaacccatgagtcctgagtaatttagaatttttcattctcagttttcctgctttctagagagttggaagaatgaactaaagatcagaaacttttcttctcagagtccaactggtccatgatggtttggggaagaacctgcagaaagagagggcaggaaattagcaaggtgagaaatcacaaaggttcttatatacaggatccagttggtgaattgcagggtcctgttatctttgctcctttttagatctccacttgcctaaaataaatcatgaccctacactttcaaagatccaggccaaccttggggccccaaggtgagtttttttctgtcttgtgaaactggtgctacttgtgtggtgtaaatcagagggttagcaagtattcagtggatttgctggtaagcccaaccttttgacaaaagagggggaagaaagaaataaaagtaggggtgggggaagtaagctagaagaataaggagagagatagagatgtgactccatcaacaaaatactgattgagtatcttctacgtgtaagactgtgctagtttcaacttgccattctaaatcaacaaatagaacccttatttgtgactacagaggctgagagttaggtgtgtctggtgtaagacagatgcacacccaggtatgaccagcaagcagcaaagtcaataggcaattactcaggaaggctgttatggaaggaatgagaatgaatgggcccacgctgacttagaaattaagttaaaacatatggcaaatgtttttctgatatgcacttaaagcctggaacagtccaagaggccctgggtttccctgagagggaggcttttaggaagagtgtaggctgcctgtggctgctgcacctaactggattacaggcctctgtgacgctgcccatcacatctgcttttcagtaatgccgtaggggaggcaagctgtccccttagacccttagcatgatctgtctatgggtttcacattttttcctggcagagttagtttttcgtgtttgttttgtgaagaaaaactttgta

SEQ ID NO: 853 - DNA, 465 bp, Homo sapiens
  misc_feature: Incyte ID No: 116549.1
  unsure 440: a, t, c, g, or other
ctggcagtagcctttaaaaaacccgcagaaaagatttggtgattccagtccacagccaagattgcggaaccactggtctatgtcggttcccttccttattgatgctatgtgttctggcaaagttgggtgtaatgtgaattttggggaaagaatttcttgcactttgttgtgattaaactcagaacaaataactataaaaagtattagccactaaactgagttgacagtctttggtaaattaagcagttaaagttggtgacattctaaacatttttgttgcactttgaaaacgtgggtgtatatcctatatactgggttctatttgttgtcctctatctcttctttctcttctaccacagagtcatctcctagatgagtatctcctgacactcacttacagccctctctatttagcttttctctccttttatttatcgttngcacagaataaagtcacaatatcct

SEQ ID NO: 854 - DNA, 210 bp, Homo sapiens
  misc_feature: Incyte ID No: 017886.1
gaaattctgaacaagtttcaggcatactggttcttcctctctttgcaacatatcaaaaagtatacattcagacttagaaattatggatctcagacctctgttggtttcagagaagagtatgcagagggtataagtgtgcatgtgtgtgtatgtatgtgtaggcatgtatttactgtgatgttactaactgtagacacagtgatatctcag

SEQ ID NO: 855 - DNA, 797 bp, Homo sapiens
  misc_feature: Incyte ID No: 351032.1
agctaatttgtcaagaaattttttatagggaagactaagcctactcagatctttaaggataacagagtaaggtctggaacctgcccacaggagccaaaagaattgctgagcattctcccattgccattcatggacttttcttttgaacagctgagcagaatgtcaagcatgcatgccccacctcctcccataggtttggctggtaaaatccagcagctgtccatgctggacccatctcaggtgtcaggttacagctgtgccatcaccactgtgaatcagagcaacaaaacagctggaggcagaacagcactcagctggagcattggtggttcagtggtagaattctcgcctgccacgcgggaggcccgggttcgtttcccggccaatgcagcagctgaaagctttttggcagctcctggaaaaagaaaacttggagaaataagttaacttggagggataagctagtgcgggccttcaaagggaggagctttttttactgggagaaactagaagactcggggatacatattttgtgacctctcactgaaatatgagtgtttgatttttgttttctaattctaattttagaaaatttggaaagtagagaaaaatgcaaagaaacaagactatccccaagaggcaatgaatgttcaaattttgatgtattttttccagtttttaatatatatacgtagttaaggatcatagaacttaacacagcttcaccttctgctctgtttgtttgaagttcacagtgcctcttaatccatagtcagaaaatagagtaacagttgcct

SEQ ID NO: 856 - DNA, 3452 bp, Homo sapiens
  misc_feature: Incyte ID No: 977532.9
  unsure 2991, 2994-2995, 3006, 3026, 3039: a, t, c, g, or other
agccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatcnctnngtgcctcaatntcctccttttaaaatggggntgatgatgctaanaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggcaaaaaacaaaaaacaaggg

SEQ ID NO: 857 - DNA, 336 bp, Homo sapiens
  misc_feature: Incyte ID No: 117273.1
ggctcgagcaggagctcatccccgctcctgcactgtggccatagctccaggcagccgcgcgccgaccccacccacaggcctgggtggagctgaaggtctaagccccatgccagaccctcatccaggcagcgacccctgggcacagggggcatggcagggacaccgatttcctcctccttctgtcagtttggacaaagattccagggccacagaccaccgtctggccgccccaaactgctttctccaaaagggcttgccccaaagctttgcccaccgagtcctggagctgctgagcgtcctgccgggcctcaccttagtctctcctgtcgccttgtg

SEQ ID NO: 858 - DNA, 830 bp, Homo sapiens
  misc_feature: Incyte ID No: 212438.1
cctatgtattgcaggatatttaccagaatccccagtccctgccccctacaggccaagagcatcatcacactctcccttcctacagtgggaataaaaaatgtctccaaacattgtttaatgtgttaaatgtgtccagaggactaaaactacctctggttgaggctcactattttagagggggaaaatacatgtaaattgtagtgagaaagaagttcatagaaaaggtttaaatacattgcatatttgaatgtatgcttttatttatatgtttcctttgaaactagaagggcttagcagtaagcccccttgtcacaaaaagtacctttagacaaatttagtcaaaaaattgaatttctcttcatttttagcaagaggcgtagtaatcaatcacatgagtaccttactgagaaaataaagcctagatttgcttttgtgtgagacctctttactgattttctgtagttttgaagcatagtctgggaattcctgaatttcagaaattacattggaatgcttatttgaaacacatcttcaaattaataaaattaagatattgatttacatccctgaaaatattttcctatctgttacagatttggggagatgttaggtgtgaggaatagtgttcctcataggatggttgctttcagagggcagtgtttgtggtactcctgtggcagaaaaaaaagaattcgtttctcttaccttaccattaggtaaacatagtaatttagggggaaattcttgtaagtattagttcacaaaaataaatgacctaagaaatttatctgccaataaatttttaaaacgttgtgtttaaaaattactct

SEQ ID NO: 859 - DNA, 639 bp, Homo sapiens
  misc_feature: Incyte ID No: 212265.7
gcaacagtcaccccgatgccttgcccagggcagtccttctctgctgcccctgagttacatcctaatcataaaccagtatgtttacactgaggtgaggccaactgctctgtgtgtggaagccagagaagaaagcagcacagaacagatgcaaaccaaggaggctggaagataagagcagagccatcaggacacgagcccctcgcgggtatgaaacaggagtcgtgggagcaaattagtaggtgcactgcatggagggacggaaggggcagggaggagcatctgaatgtaagatttcagagaagctcattttgtcagcatttcagagcttcctgtgtgcagcatggatctaaagctggtggatgcaggggggtgaacaagacaacatcttcacttcctgcatgctgatggcagaagtgagacatcagcgaagaaacatcacgatcaccaaattacgatgaacaccatggaggaaacaaaggacactgtgacaccaaggaaggaagggaggttacttttcatagtggctgtaaatagaactgaaggctgaaaaacagctgttaaaatggcttgtttgtttgaagatgaatgagagtacacaataaaaggccaaaaatttggacacagacacacacagaggga

SEQ ID NO: 860 - DNA, 841 bp, Homo sapiens
  misc_feature: Incyte ID No: 403560.1
ttatcttaggggacggagaaaagagcctctttgaaaggtcaaatgtgggtgtagagattatggaaaaattcaatacaattagtgtctccaaatgcaacacaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaacattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgtt

SEQ ID NO: 861 - DNA, 1683 bp, Homo sapiens
  misc_feature: Incyte ID No: 1073168.6
  unsure 118, 142: a, t, c, g, or other
attgatcagatggatgaatacctcaagaaaatggggagagaccaaatttttaagaatacatttcagggcatctactctgatcagaagatctgtaaagactgtcctcacagatatgagngtgaagaagctttcatggctctcnatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagtaagtgttggagttttttaattaaaagaaatttgtgtctcttccagtgatttagagctgaagtttcttataaccctttttatttcaacttgaaattattgttctgcttaaagtctattttaaactctcttcactgaaacagtgaggaaataattcaggtcactccaaaatcatctcaggcaagtattcagtgaccacaagaagagcctgtgaggcagatcgcctgccaggtactcataggcacgtgggtcttaaacccctgctatggttcaacagggggtcagagacgcaagtctcttccctcagggactcggaatctggtggaacgagagaaacaatcccagagtaccacacatttcacaatattgtctaactgtgtttggattctgactaacaaattattttccaaaaatctaccggtaggccaggtgcagtggctcgcacctgtaatcct

SEQ ID NO: 862 - DNA, 5734 bp, Homo sapiens
  misc_feature: Incyte ID No: 1073168.8
tagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcgggcccatagggcgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaaaaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtgggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaaggttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaataaaaaaaa

SEQ ID NO: 863 - DNA, 295 bp, Homo sapiens
  misc_feature: Incyte ID No: 119614.1
  unsure 261, 266, 275: a, t, c, g, or other
gattaatagactctgatgcataattgactctcccaccaggaggaaaaaaaagagagacagtctaatcgtagccctgaaaaaataacattcccataaagagatggtgtctgtccacattgacagggtcagggatagaggagtgtggctagcaccaccaagtcaggagagaaggggagacggatgaggagtcagccccagggaagggagtctcagaacgtcgatgggacatgtctcatcatttagaggcttcagtggacaccntgaanaattggctntattgcagaactggatggga

SEQ ID NO: 864 - DNA, 356 bp, Homo sapiens
  misc_feature: Incyte ID No: 119625.1
atttgggaagtggtactagcaagtttaggggatttatttttcactgcattatttttggtaatatttaaagtgttttaagtttttaccataaatgcatattacctttagactaaaaaaattttcttaaggcatgcaaatattcatgccttcatgaaggctattaattaaacgttgtatataatagcaaattattggaaacaaccaaaaaagtgattagtagggaccttgtaaggtggaatactatgcatgtataaagaagaaaagagcttattctggtaaggaataatgcccaaaacatagtgttatgtgaaaaaaagcaaagtacacaactgtgtatgatacattaccatttgtat

SEQ ID NO: 865 - DNA, 404 bp, Homo sapiens
  misc_feature: Incyte ID No: 119671.1
  unsure 275, 305, 308, 342: a, t, c, g, or other
taaatattagtgtttctgttatgaaactgaattaatttattatattaccggtaatttccagcagtttctcttttaatttttaaacaattttatttaaaaattaatatttgtgagactaaattctcaaaaccaaacttcatccttaatgaatacatttcaattctttatgaaaaggaagagctgttaacgttttctgacaagtaatgcattatagttcatcattttggcacaggataggcttgagttttcttctgacttcttaaggacatatgtantgggaggcacttatcttttttttttttccnaangtttgattagcagtttgaaatgctaatgaaattngcaaattaaatggagatttgatgaagtaaaatttgaaattatgtccatatgctttattcctt

SEQ ID NO: 866 - DNA, 2398 bp, Homo sapiens
  misc_feature: Incyte ID No: 003177.1
  unsure 1561-1605: a, t, c, g, or other
ggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattataccaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgtccattctaattggaaatccagataaggggacagatgaggaggttctgaccacctacctccctggcttgggcagacataggagttcttggcatcttcataggtccagtttttctggaggaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcacataacgagatactgtgggctttagcagaaaccaccagtatatgtatttagtctttaaacacataaggttcttaaaaaggaatgtttatttaattgcctacacagactgaataccgtgatatttatagtaggactctgggtttgtttaggagcacatgctgacacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataactctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtannnnnnnnnnnnnnnnnnnnnnnnnnnnnnnnnnnnnnnnnnnnntggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccgtgaaaatatacaattgtagataatcttttttaattggagagatttcctcttatgtccaattttatacataaagtaagacttttttattgtgtgcctaaatttcgtgtaaatatgactgcatcgtattagtaaactgaattaggtagtgcattcacataaaatttaacatcaccagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccacaaaactacagcaaacatcattcttgatggtgaagcattggctgcatttgcattaatgctcagaacaggaagaaaatacccaacaccacaaccatcagtaatctactagagttcttagtaattcagtaaaacgagaaaaagaaatgtgagatagaaaagaaaaagacaaaactgtcattag

SEQ ID NO: 867 - DNA, 295 bp, Homo sapiens
  misc_feature: Incyte ID No: 119974.1
atttgtagaaagggattaattatagaaagcagctcatgaaattatgtctgctggtaaatccaaaatctgcagtttagcaggtttgagaacaggagagtcaatggtagttctagttagaaggctggcagcctggagactcaggagagctgatggtgcagtttcagttcaaagggcagcaggctcatgactcatggaggagccagtgttgcaaatgaatttttaagggcaaatgttgcagataaaatctgaaggcagtctgctggagaatttcttttttcctcccggaggctggtct

SEQ ID NO: 868 - DNA, 958 bp, Homo sapiens
  misc_feature: Incyte ID No: 120831.1
  unsure 859, 895: a, t, c, g, or other
aatttttcgttatagttttgtgggatgtgactcctaacgtcacacggggtgtacacacagtgatattacgtgtaatattctatagaaatgttactcgtaaatcacaggtcctgtacacactttaatattcttcgtcgtattctaggaaaacgtgactactaacgtcacagggcgtgtagaccctgtcataaaattcgtaatatcccagcaggagttcactactaatttcacaatgcgtgtacagcctttgatattgttcgtattatccttaagagatgtgactactgatctcccaatgcatgtacattctctgatattattcgttatatcctcgggggatatgacttctaatgtcatatggcgtgtactccctgtgttctatttcatagtatcctagggcaattgtattgttaatgacacagggggtgtacacattgtgatattattcatgatattctagaaggatgttactcctaatgtcacgggggtgtacaccctgtgatagtattcataatttcccaggggtctatattcctaatgtcacagaagataacaccctgtgacattatttgtaatattctgatgagatgattctcctaatatcacagggggtgtacaccctgtgatagtattcttactattctagggcgatggcactcttaatgtcacaggtatgttccttctgtgatattattgaaaatatgctagctggatactactactaatgtcacatgcgtgtacaccttgtgatattattagtaatattctggggggatgttacccctaacgttacaggggtgtacaccgtgtgatattgctcccaatattgtagggggatgttactcctaatgtcacagtnggtgtacagccttcgatattatttgtaacttatggngagatatactttaatgatcacagtgggtgtacatacatgggctacaaccactgggatattatt

SEQ ID NO: 869 - DNA, 1372 bp, Homo sapiens
  misc_feature: Incyte ID No: 027619.3
gggcctgccacctgcacctgcccccttggatactaaacagggcaaattaaaagcccccacgtggcaagtatgtgggaggggaacaagagcagatattgtaatggcaggtcaaacagctcagggcaaaccatcaatgcttataaaatctttactgttattaccatcatcattgcgatgccatattcatagatggagaaacgaggctcagcatggtgagtctcaggaactcccagcagggtctggggcccgtcctctcccaatgccccccacccacacctggccctgagccccaggaagcgtgatcccggcgtggcctagccggacattcgcctgatgcaactatcgcaccactgccaggcccttgtgcaatgcggggcaccaggtcggccagttaacgattgactggggatcagtgggggtatgaggcataaaaggcttcagtgacagtgctgtggctataccttagaccctcagtcatgctcagtgccctgctcctgtgcctggctctgggccctggtcaatggtgacccggcctgcctcagcggcccccatgggcggcccagaactgggcacagcatgaggatctgaccctgcttcttccatgggaccctggcagctgggccaggccctcaacggtgtgtacaggaccacggagggacggctgaacaaaggccaggaacagcctgggtctctatggccgcacaatagaactcctgggggcaggaggttcagccggggccgggatgcagcccaggaacttcgggtcaagcctgttggtagactcatgatggaggaggatattctgcagtctgtcaggcagaggccacagctgaggtgtctgggggaggtggcccatggcacagaaggtgctactgggatcagcgtgtcagcggtctagtatagtccagctgaggagacgcctggctgggccctgcctaccgtagatatttgaggtcttaaaggctcacgctgatcaagcagagccacatcctatgggccctcacaggcctacgtgcagcggcctagaggcgggagtatggtggcacagctagcatcggtctgcgacagatccaggagagactccactacagcggcgctcccagcctgaatctgcctggatggaactgaggaccaatcatgctgcaaggaacacttccacgccccgtgaggcccctgtgcagggaggagctgcctgttccccgggaaccacccaggccaccggcccccacttctgagcccagagcagagacagacgcagccgggcacaaagctagaggatgtagccccattggggaggggtggaggaaggacatgtaccctttcatgcctacacacccctcattaaagcagagtcgtggcatctcaaaaaaaa

SEQ ID NO: 870 - DNA, 622 bp, Homo sapiens
  misc_feature: Incyte ID No: 212872.1
ccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaaactagaaaattggattctagaccaaaaa

SEQ ID NO: 871 - DNA, 2445 bp, Homo sapiens
  misc_feature: Incyte ID No: 404952.4
  unsure 1289, 1292, 1299, 1302, 2269, 2333, 2338-2339, 2404, 2432: a, t, c, g, or other
tttgaaattaaacttaagattggtatgtattcttattttatagcaggtatattttaaaaataaaatttcccgaaaatgtctattataatgatttagattctcttttcagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcatttnctnacctatnctnaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcntagttcacagttattcccacaaaagaaaaagccaacaatagtgtaccatttttctatttatttnattgnngtctaatcaataaagaatgcagagctgtcaaaaaatgtgtcttacattagctgtcccaacaggantgtcttccctcccagctctgttttaatnggcttttagaccc

SEQ ID NO: 872 - DNA, 4027 bp, Homo sapiens
  misc_feature: Incyte ID No: 404952.1
cggaggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactacgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccaggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggatcaccacaagtgagtttgatgatgaatttgaggataatgatcccttgcctgctattggacactgcaaaggctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaaa

SEQ ID NO: 873 - DNA, 491 bp, Homo sapiens
  misc_feature: Incyte ID No: 125014.1
tcccgcctcagtctcccaaggtgctgagattaccgcatgaggcaccatgcctggcctgaatttggagctttaagaatgggtaacttgttctttctagaaagttctacataggtataacttcaggaagaaattgtaatgcttttaaaatactccctatattctattcattaagaaaccaaatccctttgatgtttctttattttcaatgataccagatggtcttggtgtctgtatactcaagttggagaatttaattaagagtttataggtaagggttcagcaaatttcaaagctagcatgcaaattatttattttggctaaactgttatttgctgataaacatttgttcccccagaccattgttaattggcagtcttggtatgtagctcatatcaggccacatgtagagtatgtagatgaatgtgaaccaactagagtgaacgcagagaatggaaaccatatgaggtgtttgaatgtcatgaggaaggcta

SEQ ID NO: 874 - DNA, 452 bp, Homo sapiens
  misc_feature: Incyte ID No: 348390.2
attgctctggtattcatgccaaagacacaccagccctcagtcactgggagaagaacctctcataccctcggtgctccagtccccagctgcactcagccacatacaccatgtgtgaagaggagaccaccgcgctcgtgtgtgacaatggctctggcctgtgcaaggcaggcttgcgcaggagatgatgccccccgggctgtcttcccctgccattgtgggccgccctgcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaag

SEQ ID NO: 875 - DNA, 610 bp, Homo sapiens
  misc_feature: Incyte ID No: 227222.1
ggtagtaagggccagataaaataggctaggaatgtagcccagtttttgactggttagcttcattccactacttcttgcctctgatcccattacactacagttaagagccacaagactagatgactgattaagccactttttaacagctttattgagatataattaaatactatcaaattctctctttatgtgttaactttgaagtatttaattccatgtaaactatttttctcttaatgtcggatcaaacagtatgcatatgctttcgtataatctaactttttaagtaaatgtgcatgtgataaaagactgggggggaatgtgttttagttatttcacaactattttaactctggaatggttttcagcaacgtaatagagttgaataacagttatttttaagcatgtaaatatactttctttgagacaataagcctttttaatcagtgcatttgcaagctactcttgctgttggggtcatactaatttgaataatccattgtatattttatcagaccatgacatatgaattccatgaaaggaaacccctctgtttcagaactcagtgctacaataagttatacttggggtggaggtaggaaaaaaaatg

SEQ ID NO: 876 - DNA, 335 bp, Homo sapiens
  misc_feature: Incyte ID No: 337696.1
ggtttcaattaagtagctataatgaatattattcttaaaccatgccattctggaaaaagattgaaacaatggaacagggtcattcaggaagcttctgtgatacccctctatagactcatagatcaaaaaaaaaaaaaaaaaaaccacaagacccttttccttttctgaataaaggccactcaacgctggtattctgggaattgtccagatgaggatgcacacttcatgcctttggtggtattgtagccaatgaggtttatccgaggtgtgattattgctaattgaaaacttcccaacactccgccatgatgacttgcaatatagtaggcattggc

SEQ ID NO: 877 - DNA, 1141 bp, Homo sapiens
  misc_feature: Incyte ID No: 253550.20
atcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactcttaaaagcatatgggatgtcataaagacctctgcagataatgaaaaatattctcataaagatagttttatttacttcatcctctatgcttgttgacctgctattggttccataccagcttctgtgccttactctgggaagagcaaaaaggagacagggagtgatggttagcttattcgggggactttcgtgctacatcagacataaggtatctgaggagcaaattacaggtcccacttttggtagttgtgcagcatcgtaagatttttaaagcacacattctagagtaaaaactgtgactctgttgctctggtccttcctgatccccagggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggttttggaaatgcctatggtttctttgaatggtaaacttgagcatcttttcactttccagtagtcagcaaagagcagtttgaattttcttg

SEQ ID NO: 878 - DNA, 1430 bp, Homo sapiens
  misc_feature: Incyte ID No: 1326925.1
caaagaagtgaacctgggaggaaggtgtgaggtagtctcagtggtggtgatcaaagaagtgaagactggaatactatgtgacatggcctcagtggtgctgatcgcagaagtcaagctgggagtactgtgtgatgcggactgagtggtcgtgattgaagaagggaagctgggagtactgtgtgagggtgtctcagtggtggcgatcaaagaaatgtagctgggagtactaggtgagatgatagaaggagtgaagcctagaatactgtgtgacatggtctcagtggtggtgatcgcagaagtcaagctgggagtactgtgggatgtggactcagtgatggtggttaaataagtgaagctgggagtactgtgtgaggtggtcccggttgtagtgatcgaagaagtcaagctgggaatactgtgggatgtggcctcgatggtggtgatcaaagaagtgaagctgggagtactgtgggatgcggtctcggtggtagtgatcaaagaagtgaggctgggagtactgtgtgaggtggtcttggtgctggcaatcgccaaagtgaacctgggagtactgtgtaaggttgtcttggtggtggcgatcgcaaaggtgaatctgggaggactggttgaggtggtcttggaggtggcaattgaagaagagaagccgggagtactgtgtgaatgggtctcagtggtggtgcttgaagaagtgaagctgggaggactgtgtgaggtggtctcggtggtggcgatcgaagaagtgaagctgggagtactgtgtgaggtggtcttggtgctggtgatcaaagcagtgaagctgggaggactgttggaggtggtctcggtggtggtgatggaagaagtgaagctgggagtactgtgtgaggggctctcggtggtcgtgattgaagaagtgaagctgggagtactgtgtgaggtggtcttcttggtggtgattgaagaagtcaagctggacgtactgtgtgaggtggtctcagtggtgatgatcgagtaggtggaggtgatcgaagaagtgaagctgggagtagtgcgtgagggggtctcggtgatggtgatcaaagaagtgaagctgggagaattctgtgaggttgtctcagtggtggtgattgaagaagtgaagctgggagtactgtgtgaggtgatctcgatagtggcgattgaagaagtgaaaatgggagtgctgcgtgaggtgatcgctctggtggtgatcgcagaagtgaagcttgaaggattttgtggggtggacttggtggtggcgatcaaagaagttaagctgggagtaccgtgggatgtggtcttggtggcagtgatcaaggaactgaagctgggagtactgtgtgagatggtctctgtgctgctgatcgatgaagggaagctgggagtaccgtgtgaggtgctcttggtggtggcga

SEQ ID NO: 879 - DNA, 725 bp, Homo sapiens
  misc_feature: Incyte ID No: 127140.1
  unsure 356, 447, 646: a, t, c, g, or other
attttttaaaatctcattttacccaggagatgggctgcccctgggaactctggaaactgcatattttctcacacaataattgaatcatactttgaaactattgtaaattgactagagtactcggtctaggccaccccttgcccttgaagagctcagaatagcagagtgtgggagaataactttgattgtatgtttgtggtgcctgaggaaactatctcaaagtactcacggatcatacccttacacaggccccactgtgagctacagcaagacaagccccccaaagcatgagcacaaacaggggtgctcaccctgctctgtccttcaccaaactgcatcactttggaatgcagcanctggagtataataatatctgaagctaccacaattgccttaaattgtatcttagcatgagttaagcttactgccttcacttagcaaatattngtcagtgcgcgatgtgtaccaggcaccatgatagacaggtagacactgtgtagacaaggtaaaatagcccatttgtattcctgacattatctgtttgtcgataaaatttgtcactaattggctttgcttttttgtttcccaccaaaaactgaacttgtagaattgagttatttatgttgcaggcagtatcactttaatngtactcacacttatttaagcttggaaaataatattttaccaattctttgatactttgtggtcccttaaatttaaccatc

SEQ ID NO: 880 - DNA, 310 bp, Homo sapiens
  misc_feature: Incyte ID No: 127204.1
ttaagatggtatgcttaatgttatatgttttcactaaaattaaaaaaaatacaaattctgtagccaaaatgtcctggacatttagttgatccttttaagttcaaatgtgaatgatttgtcatgtataattatttctgttgaatgtaaacagtaccttttagagatgaatattgggtggccttatttgtttcaatatctttggccctaaattaccaggcaccaaaattgttactcatttttttttccaaattgtacttagagatactgtggataaaccatgcactacaatattaaccttaagaatggtacc

SEQ ID NO: 881 - DNA, 1243 bp, Homo sapiens
  misc_feature: Incyte ID No: 330925.1
aaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaagtttcacagcggtacttccatgcaactttaaatctcactgctctctatggttgatgtcaaatgaccttcagtgatgactgagcattgaatacaaatagattacaaagccaaaatttggatgttaaatggactcaggaaattttagttgtattttcaattcaagtacttagtagcctacgtttgcttggcctctggttctttatggaaaataggctttggtagtggcattgtggagcaaagggagactgttacaccttaattaactttttttactgatgcaaataatttgaggatagagaggagggaagttagtgaaagctatgacctaaaacattgggaccaattagaggctcacagatatttggattattttatgtgcttattattaaataaggaaagccattttgtgatatgtggaagacgctatgtgaagttttacctatcttctcaaagaccttttcttttgtattttcttttggtgtttcttaaaagccaaacaaagaaatgttcttaagggagacagggtgggtttttctgtgggcctttgttggtttttctgtgggccatcgccctctaatggaattgatctctggctgtttgatttttttcatattgtatttttaaaatttgttgtacagtgccctgtgagcaccaagtaccactagatgaataaaacgttttatatctaaagtcttagtagaccaatttttaatcttagttgactctgtattgttatcacactgcactctgttgtggttgtgccatttttgcaaaattgagctctttcggttgttttcgaaataagggaacttagtgttgaaaaaccagagaactttttctttaataagaaactaaaaaagttgcagccacataggttcagtttggctctttggtttccagtggctctcaaatcccctaaggttaaaagaaaacactacagctaccctagggtttctcaaccttggcattattgacatcttgaatcaaataattcattattgtgggggtgctgtcctgtgccttgcagaatcttgagcagtgttcctgacctctacctattgagatgccagcagcacacccccatc

SEQ ID NO: 882 - DNA, 1032 bp, Homo sapiens
  misc_feature: Incyte ID No: 403960.1
  unsure 546: a, t, c, g, or other
ggagaatttagtgattggaaacgaattaatattgttaagacacaaagtttcttgcagagccactctgaaaaaggtcattttttacccctcaatatgtcttaatgggttgaggtagagagaagcgtgggtaggtatcaatcacgagagcacacaggctaaaagaaagaaaaaatgagctgggacatctaagttcaacttccacttcctcctatacaagctgggtgaccttttcctatctagaaagtgggagaagtagttcctgtcctcccttacagggctgctgagcaggcagaatgagatgatgggctgagagggcttggagaggacaaactgtgggtacaaaagtcttattgtcctggcccggattgctaaggagatggtggttaataatatgctgctatctcatgaggtaaatgcgtgatcacatagccaagagatgcctttttgttctaatgatcactgtaagaccttcttgagagacagtccaagtctctccagcacaatggaaaattgcattttctatgcacacattcgaggggaaagagncccctccaacgttcttctcagttttaccccaaagttgagttctgggtcaaaaatctctcaagcgtcctccacagctgacttccacagtcccctgtgtgtctctgcaaggaacacaaaggaagtgagatagtgggaagtctggggccatcttcggttacgtgagaattccctctcagttagccggggcgtgcagccgcacagaaggaaggcagccacgcagctccagtccaggctgggagagagctttgtagatccatctcccactgagcaggcttccctcctgcaaggagagactctaccgataatgtgttaagatcagattaatgcaggaaatacacatgaaataaataataacagtgtaataacagtggctgtcattgcaatggttatttctgttaaaaatgtgagatctacactacggatttcttaggataattttgcccttacttaaaagaaactgacagatgtactttataaaaatgaaaa

SEQ ID NO: 883 - DNA, 1077 bp, Homo sapiens
  misc_feature: Incyte ID No: 020152.1
  unsure 599, 1001: a, t, c, g, or other
tcattaggtcccaaagagaacctattgcaacatggactccataacgttcttgaggatcatcctgagaaactgatgtctctcgttagacaaaaatgcacgatttgcttgggaaaggggagtaaaaatggtgctggcatccattggctggctgggaacttgaaccagcagctccaacaagcgacatgtagaaaatgaggtataggccgggcgcggtggctcacgcctgtcatcccagcactttgggaggacaggcgaagtcaccacgcccagccaccccatctctattttaaagaaaatgaaaacgtattatcatcggtcctatgatcaccaacatttggcccaaacaaagtcacaatacttggaaattcggggggtgaaactgcagccgccgcgtcccgaacttcagaagggtccccgtcagcaccacagcagcttctgattgagcgcgatgacgtcactgacgaagccgtctgcgccgatgaagtcccccgcgatgatgttggtgcaccgtgaacccggccccgggcactgctctcggaccccacgcgcctcagcccgcggaaggttgggcagcgtcatcttctccagggactcggacngggtgcgccagaaacgtactgcaggttctccgtgagggttgatgccggccacgaacaaccctcctgcaacggtgagggtggggagaggttacacggtcacgggcctcacccgcctgtttctccctcctagtcacattattagaggttcgcatctcaggaattaagagttgaaagcaccatgtccaacaaggaaattgggtgagctttgcttataaagcgtggtgggcagtagacaacccccaaagatgctcacgtcgtaacaccgtgtgggagacagaataatgtccccaaagatgtcacatcctaatccccatgtgatagacaggataatggccccaaagatgtccacgtcctgatccccatgtgatagacagaataatgtccccaaagatgtccacgtcntaatccccatgtgggagacagaataatgtccccaaagatgtccacgtcgtaatccccatgtgatagacagaataag

SEQ ID NO: 884 - DNA, 908 bp, Homo sapiens
  misc_feature: Incyte ID No: 026200.1
  unsure 636, 750, 794, 797, 826, 897: a, t, c, g, or other
ccacaaactaatgaggcagcaggtgtctgaagagaaacattgcagaatgtctgccaggggttttatggttaattttcctccattatgagggttgactcagccttgggtattagatgtctttgagaatccagggttcaaataccacagctggtagaatgtttctcaacttggagccaatctccatctactgaaggtacgctggtttagacagacaacagggacatcagcattttaaaaagcggtggaaaaagtttgcttgtcttgattggagccatgacattttattttgaaatttcaaataacatgaagggaggtttggagcggtttttggtttatccaaagggcagtggattgaaggctgagaaacaccaggctgaatgggagaggggttggggtccccctgtgagatagtgaaacaatggtagtgccatccaatgataggcacttttctgtcattcagaagcagaaagggggccagaggcccattggccttactgggcagtaagctgtagagctgctgcccttttcgtgaaagggttgacaccaaccttctcccccaggaagagtgaccagggacctgaggggcatggtcgagcagatgacagcctttgtaaaacatctccctggtctcatcancgatattcgtcctgccttccttctgagtaatttccatcttaggactggagtcaggtggagcaagattccatgttggtttctgttgggcctagagtgtcacactgagacctaatntcatactttatgaattctagtactgctctcgaaggtaagagccntcntctttggctgaaggtttttgcctgcaacnttgcattgtaatccagtgacacctgacgtatctgtaaatttcttcaaatttctaagtgtattacaaccccngtgtgcaaaag

SEQ ID NO: 885 - DNA, 4370 bp, Homo sapiens
  misc_feature: Incyte ID No: 399474.1
  unsure 2189, 2191, 2202: a, t, c, g, or other
agtggaagcagcatgaaggaagagccgctgggcagcggcatgaacgcggtgcggacgtggatgcagggcgccggggtgctggacgccaacacggcggcgcagagcgggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacagattcttcttgatatttttcctcaaatgtaaccgaaattgcctaatgaatgcgggaaacccagcgtgacatgcggagattccaggtcgtggtgtctatgtacgagtcaatgctgtgatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttcttttccttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaananaaaaaaaaganaaaaagtaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtccaagaaacatagtttatgcttttttttaaatgaaaacaaacaagtaattttgtaaaagtcagaaaacaccagtatccttctgatctcatcctggatttttctgtcagctggaggatgcatttctgaccccatcccagacacgtgaaagcagaagacatgatgcatctataataatgaaagcacaatctaaagagtattatcacaccgtgaacagcttcttcctgacccagagcaaatattaagagaaagacaatatatttacaaacaagatttaataatgctcacaagaatagagtttgcccccaaatggaaaattacacattattttgtttcaaaaagttataaatttagtgcttgaaaaatccagcaggtaagtagaaggactaacagggtctgtttctggaactgtccgccagcaaatgagcatgctctgtcctggaagccatttttctttttcttt

SEQ ID NO: 886 - DNA, 1312 bp, Homo sapiens
  misc_feature: Incyte ID No: 981037.1
gggcggaatgcggagcatgtctctctgggtcgagttcatcacggcgtcgggctatctctcagcgcgtaagatccgctcgcgtttccagaacgctggtggcccagcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactcagctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatcccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtc

SEQ ID NO: 887 - DNA, 799 bp, Homo sapiens
  misc_feature: Incyte ID No: 130502.1
  unsure 499, 506, 643, 691: a, t, c, g, or other
gtgcattttccagagtatgtgttctgaccaatacattatattttattagaattttagggggtgggagcaatattgagtttgatgactatgtatacgttgaaggaaatgacgtatcaagtctcatgtaagataatggagctttgctccttttagttaacttaaaattattgcagtgtctgcttgtcttccagtgaaattgcaggtaatagctgaccttgcttctttaacatctcttcctctgggttacagaacaacccagaaattctaaaatataaataccagactgccagcttaattctgaattcctgttggggccaaatacaatttacttgtaaacacttaggaccaataaagtttagatggagctcataattatacaaactcatctcgttcacaaatccctagggctcaatgttaaagtcagccattgtttaaggcagaaattcaggtttagatatagtgtagcaaagattttccattatatgagatatcgatcctnttaaacntaaaacttttctcttggctttctattttactgtcttttgttgccatcagctgtatgccccttaattttttctagtaataccttggaatttaaaaatgaaattacaaatgtttatgttttagtgtttttaaaaataantcgattaagtatgctatgatagaggagcaaagttgttattagtaatancaatgtgcttacaacttatggaaatgaaaaatagtctttagtcctagcagcctttctgctgtagtaaaatagtttgtgcactttaaatcgctgtgaggttacatcttc

SEQ ID NO: 888 - DNA, 3640 bp, Homo sapiens
  misc_feature: Incyte ID No: 5202390CB1
acctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttc

SEQ ID NO: 889 - protein, 1076 aa, Homo sapiens
  misc_feature: Incyte ID No: 5202390CD1
MKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 890 - DNA, 537 bp, Homo sapiens
  misc_feature: Incyte ID No: 213447.4
cccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgc

SEQ ID NO: 891 - DNA, 418 bp, Homo sapiens
  misc_feature: Incyte ID No: 250439.1
  unsure 337, 392: a, t, c, g, or other
ggggaaccatgaccttcccaaatagataaatcaaggaaccagtgactaaccctaatgagaaggcaatatgtaaactctaaccaacattcaaaatagcagttttaaggaaacccagtgatcttcaagataacaaagaaaagcaattcagaaatttttcagataaatttaacaaagatttaaaaagtcaaacaaatcttggaactgagaaatatatttgctgaactgaaaaatcattagatgttttcaacagccaaatggatcaagcagtggaaagaattagtgagcccaaagacaagccacttgaaaatatgctatcagaagagaaaagaaaaaaganagggatgaagacagcctacaagatatagaaaattacctcagaagatcatatctanaaattctggtgttgaaaggggacttg

SEQ ID NO: 892 - DNA, 5907 bp, Homo sapiens
  misc_feature: Incyte ID No: 2743049CB1
ttccggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacagcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaaaaaaaaa

SEQ ID NO: 893 - protein, 1115 aa, Homo sapiens
  misc_feature: Incyte ID No: 2743049CD1
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 894 - DNA, 724 bp, Homo sapiens
  misc_feature: Incyte ID No: 256026.8
cttttggctaggaagtaaatctgtacattttctttgggattgacaattttatcggtaaaataaatgaattgggttaaatatggatgataaaaagacaaagattaatttttaacagtctaaacatatcttagaatttaagctttagaaagggcacaacttcactcttctagcatttgaaggacacagcttacgattttgaagcatttgcataatgtgttccttgatcatcggcagaacgagctttccaccaagtccgcaagccattcgatctagagcactctcgcctgcaactgcattgctgtcaaaatcatcatcttctagttcatctgcatttgcccagtcctcatcttcttccaaatcaaccatcattgctaacatctgaggaatagtctgtgcaacaatattggtatgttttcttaacatagcagctgcagtctcagagagggtgacgatcacttcaagggcaagctggcgttgcatattgttgaggctagtgtctccacacaactttagacttagctgtagagttgcttccaagtgaggacgcaaatactttggaacagtatctgcaatctcaacgagggattttaggacagaatcatcattctggtagcacgagtcatttaccgcctgtaggaatcccggtagcaagtctgcaaaatgtttgaacagagcaacattatgctcatttgcaagtataaatgcagctgtagctctagcagat

SEQ ID NO: 895 - DNA, 990 bp, Homo sapiens
  misc_feature: Incyte ID No: 998930.1
  unsure 984: a, t, c, g, or other
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgaggaaatgtctctcagtaagtgtgcggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttagcttttcaataaattaggttgtaccttccnctggtg

SEQ ID NO: 896 - DNA, 526 bp, Homo sapiens
  misc_feature: Incyte ID No: 981149.2
gagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttatttacatggcagaatacatgtatgaatatta

SEQ ID NO: 897 - DNA, 2715 bp, Homo sapiens
  misc_feature: Incyte ID No: 335420.1
  unsure 44, 164-286, 976-1007, 2387: a, t, c, g, or other
ggaaatgagggtggcctccagtcaatggctggtgagaaactganaccttccttccaacaattgtcaagtaactgaatactcccaacaatcatatgggttaggttagaagtgaacctttctctagttgaggtttcagataagaccacagatattatactaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgatttgttctacagcaattgataatgaatacttcaacctatagtgacaactggatgtctatttactcattttccccaccaaagtgtaaagttcctacaaggcagaggttacaacatattcatcctgctacctctcatagcccataatatacaacctggcccataaaacatgattaatcaatgtttgttaaattaacatgtattttgagtttcattgaaatcagttagttgaagtgataataacatttaaatgtgcatgagcagtaggacaaggcagatagctggttaggatagaaagtttttgaaaattgtgaggggaaaaattatttctatttgtaccctgttgtacccagcttaggtttcaaaaactttcagggggtttttattcatttaccaaagacgttcaaagttggtgcctccccaccactctaaagaggtctttgcccttattgacccaaccatacatgaatttgcctggtgcacagtgggagtattataaggagaggggagaagaaggaaatagaaacaactgtgaaaaaggttgaaaaaaatagcgaaaaggatagaaaaagagcagaggaaagagaagaagtagtcaacatccaacccagatgcagagaaatgattcaaaagaaaaagtctgattttcctgtcggaaatatttttaaaaggaggtaggcgtttatcnnnnnnnnnnnnnnnnnnnnnnnnnnnnnnnngtttgtcttccaaaggacccaatactcttggaattcaatgacctaattctgtgtatggttgcagtgtggagattgcctcttgtctgatctctacggcattgagacctctgatttctcaacagcacatgccacagcactatcagaagtcaggaataaagaacagagggtgtggggggcagtctagatattatgctcagcaaacatatttttaaatcagtgtaaattctatcttgctggttgcttatcttagcagttaaatcaacttttcgttacttttgtagacattatataatatcttctccccgcagctccagccaccagctgttagtcagcagaatgggagagggactgggtcagcttaagctgaataacttccatggtggacatttgagggaaccaattcccagccactgaacaaacctaaaagttctgctatggccatagaaccaaatagatcttaacaaagaaacctgagagcattcaaaggtcaaaacaattggagctagttccttcaagcttaaatatgctcatctgtaaagtggggacaataactgtgtgtcttatagggttattttgaaggctaaatatgtgtaaaagcctcagtctactgaaaggttgctcaactgtaacactcttttcattttgtgagggatcattctttgttggaggttagggacactgtctcgtgcattacaggatgtttagcaacatcctcagcttctatccatcagatgttagcaccccccggcacggaccaccatcttctccatcatcaccatcaaatatgtctccagacatttccaagtgtcccctaggaggctaaaattggccctggttgagaaccactgttctagtacttggcattgttccataaacatcagatgatatttttatcattataattattactaaaggcaacatcaccctgctatggagacaggtccttggtctcacggaatccctgcaatagttgctgcatttctgcatctttctgagagtaagggttgaaaagagataaggtcaattcatctgacaacaatccaatgggaaacctactgtctccgtagaaattcttttcatggaaagaaaaggggctaccattttgatctgctgcaggaactaggtctattcctcagcctcacagtttgcaaaacgctacagacttttccatgggcataaattctccagctttagggattgctggtatagttgactcttgaagctgctcttggatttccaagggtagcacccatttttacctgagaaaagaaggaaaaagatattcaagaaggagaacttttcaacagaagttactccatttgctgtttttgtggttttgtgcttgtttaggtttgcaagtgtgttttctgcccaaattgntcttgcatattctaacagtgtttgctttacgtgtttttgatgccacgctgttttgaaggtacaaatgtttttcatggcatgtcttgtgttaagtgtacaaactgagacgtgaatgtcagtgactgaatagagtacagtattcctcaaagtttgtaactaaataaaccctaagagaaaagtgaagcgagatttctggaggtctggaagtggccagctgacaatatacatctctgtatctcctatttttatctttatgctaaatgcaaattttactttctgtgctaaaataatgtttcattagtttcaaggtaaaaatgtgtaaatagac

SEQ ID NO: 898 - DNA, 1658 bp, Homo sapiens
  misc_feature: Incyte ID No: 1082203.1
gatcaggaaaactgagacaaatttgtcaggcaagtcgtagtcatcaacaacaaaagaatatctgaagagtcaggtcatccatataatatatctggaaaaatatttcatgactgcacagacctagatacttcaaaacaaagactgtgtaagtgtgattcatttgaaaagaccttgaaaccaaatattaacctagtgagttataataggaattttgcaagaaaaaacattgatgagaattttagatgtgggaaaacacctagctacagttcttgctattctaagcatgaaaaaaatcatagtggaatgatacactgtgaagctactcattgtggaaagattcttagccataaacaatctcttattcattatgtgaatgttgaaactggggagaagacctatgtatgtgttgaatgtggaaaatcctttctcaagaagtcacagattattatacatcaaagaattcatactggagagaaaccttatgattgtggtgcatgtggaaaagccttcagtgagaagtcacaccttattgcacatcagagaactcatactggggagaaaccttatgattgttctgaatgtggaaaaggcttttctcagaaatcatccctcattatacatcagagagttcactctggggaaaaaccatatgaatgtagtgaatgtgagaaagccttctcccagaaatcacccctcattatacatcagagaatacatactggggaaaagccctatgaatgtagagtgtgggaaagccttttcccagagtcacagctgattatacatcacagagctcatactggagagaagccatgtaagtgtactgaatgtgggaaagcattctgttttatacattaaagaattcacactggtgagaaaccctacaaatgtgctcaatgtgaggaagccttcagcaggaagtcagaactcattatacatcagataattcatactggggagaaaccgtatgaatgtacagaatgtgggaaaacattctctcgcaagtcacaactcatcatacatcagagaacccacactggagagaaaccctataaatgtaccaaatgtggaaaatccttctgtcagcagtcacatctcattggacatcagagaattcacacgggagaacaaccttatgtatgttctgaatgtgggaaagccttctctcagaagtctcacctcccagggcattggtgaattcatacaggagagaaaccttacatatgtgctgaatgtggaaaggccttttctcagaagtcagaccttgttgtacatcagataattcatactggagagaaacctgatcgatgtactgtatgtgggaaggccttcatccagaagtcccaactcactgtacatcagagaattcatacactaatgaaatcataagaatggtctgaacacagaaaagccttcagggtcagttcaagccttaatagatagtgcaacaaccaatggatttgatgattttggggactacatctttgttgataaaattttacaagtgaagtcatgttcctaatgtatttcattctttatcaaagataatagagaagtcaatacgtaaatgatggacattttcactatggcatataaaagtttttaaattgagaaatgaatgattagcataacagaacgaattgcatgtacatctcttt

SEQ ID NO: 899 - DNA, 4303 bp, Homo sapiens
  misc_feature: Incyte ID No: 225420.1
cttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcattttgggatcctatgacagagaggcaaatgttcattgcacacttgagttaagcagtagtgtttgggaagaaaaacagaggagttctattaagacggttgaattactaaaaggcaatttacaaagtgttggacttacacttcgtcttgtccagtcaactgatgggtatgctgggcacgtcatcattgaaactgtggctccaaactcgcctgctgcaattgcagatcttcagcggggaggatcgacttatcgccattggaggtgtgaaaatcacatcaacactgcaagtgttgaagcttatcaagcaggctggtgaccgagtcctggtgtactatagtaaaggcctgttgggccgagtaatccaggggtcgcctgtggtgcaagataactttgggcagttgggaagaaaaacttttggtgcaagctcatgccaatcgggttatgcaagaggaagctgccgggttgacagtagatactgaaagtagagagctggattctgaatttgaagacttggcaagtgatgtcagagcacaaaatgagttccaagatgaggcacaatcattaagtcatagtcccaaacgtgttccaacaacactttctattaaaccccttggagctatatcaccagttttaaaccgtaaattagctgtaggaagtcacccactatcaccgaaaattcagtcccaagatgtggataaagctccatccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagcgcagagaaggtggtgccacctcctcttgtagataaatctgctgaaaagcaacgcaaaaaatgtggatgccatagacggtgcagctgcacctaagcaatttttagcaaagcaagaagtggccaaagatgtcacttcagaaacttcctgccctactaagggacagttcggacgaccgtcaaacatgggaatcatcagaaattctttatcgtaataagctaggaaaatggacaagtaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatatagttactaacgtagaaaaagaaaaagaacccccatttggttgaagaagtttctgttctccctaaagaggagcaatttgttggacagatggcgtttaacagaaaacaaacacagttttcaggatactcagttccagaacccaatcatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgagaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaaccaaaaacacacacccaacacgtcagacaacgaaggcagtgacacggaggtctgtggtccaaacagtccttctaaacggggaaacagcacaggaataaagttagtgagaaaagagggtggtctggatgacaagtgttttcacttgcgcagttaaaagaaattggtcgtgatctgtacaggggcttgcctacagaggaaaggatccagaaactagagttcatgtaggataagctacagaatgaaattgatcaggagttggaacacaataattcccttgttagagaacgcacacacaacgagacaactgatacaaggaaaaaatcacttctttctgctgccttagctaaactcacgtgaacaggctacaagctctaacacttctttatgattcccttacagagcaggcatttgaagatatagaaactttagaaagtctgtctttagaccagcactccaaaaaaattaagccaggttccccaggttgttccggaagaagaccttgataatgaaataagccaactaatagactctcagccattcagcagcatatcagatgacttatttggcccatccgaggtctgtgtagcagacaggtctatttaaactttcataatgtacagggtataagttgcatctaaagtaccacagatacaaccatgtttaaatcctcgtatgcactctggccctgcttctccagttacttgcttgtgtaagaacaaaaatgagaaaggttgttttccagtaaaaacatgaccagcttactaattggttgtgtttggattgcatttatagctatgcttttttgggtttatactgggaatttatttttactaaattatttaacttttctaattatgtaattatgtaagctagcttttcatgtttatgtatgtatggtgtccccttgtgttattttttcttccttcttggtttttgaattagtggttaaatagaaatactgtcctggattccttaaaatattttcatttcccatcatggttataacaaatttgcctgcatgcccaaactgacaacagccaatcactgagggaacaggttttgaatctttctttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtacaaatatggtgacctcatttgaagagcttacattgaaagaccatgtaataggaaataaatgctagattgcagttggtcaagaattttgtagagaggataacaagacttaattactgaaaaacagtaacatagcattttgaaatataatcttttaaaatattgatgctttccttttaaatggaaatttaaattttatgattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaa

SEQ ID NO: 900 - DNA, 1916 bp, Homo sapiens
  misc_feature: Incyte ID No: 236298.4
ggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaaaaaagaaaaaagcagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgc

SEQ ID NO: 901 - DNA, 1307 bp, Homo sapiens
  misc_feature: Incyte ID No: 236298.2
  unsure 44: a, t, c, g, or other
gggaaatgcttttgtttaaataggtcagtcagttactgggaganaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttccccctttttttttgtggcatatcatatgttggttgatatttctcagaggtatccctatttcttcatacttaatatacatctccatttacatctttgactctctgaggtcaaaacaacaataaaaagaagtaaaacaactatctgtgtttgtatatacaactgttatctaaaataatataaaccctag

SEQ ID NO: 902 - DNA, 655 bp, Homo sapiens
  misc_feature: Incyte ID No: 982813.1
  unsure 611, 632: a, t, c, g, or other
gacttagaagagttcatatcaaatagtgttattgaagtatgcagaaattatatttcacccacatcagtaaggtcaaatgccttatcctcagcaatgtgtaccaggttgataggacattgccacagtcccaccctgtctgatctattggcaatcttatacagtccgattacatagtagaggtaacgtggggtggggtcaggagcctgtgcgtgggttccagcccactggaccctgcatggtagagacaaggggcatgctcattaaggggaagggtaccccttgctatttactgtctttgaaaaatatgcttcccttactgttagtcagagtcttgctgcttcaaaaccacatcagcacaagagtgttttctcagcagacaacctcgtgtttatgccgttctctacaaacacagctatcattcttcttaaaggggaaggcactgtactttgcctctgattctaaatgggaatgtttaaaaccaaccaagtgcccgagtctaaggatgtcacgccaacttctacagcaagatcgggaccactaacgttactctatcaccttccatctttctctctaacataacacatgcacatctctctctctctctcagctcntctcacattaggtgtacaaanccgtttgaaatcagtagcaggag

SEQ ID NO: 903 - DNA, 438 bp, Homo sapiens
  misc_feature: Incyte ID No: 154771.1
  unsure 116: a, t, c, g, or other
gaggggcgcgggggctgctggggcgacgcgcgctggtcggcttcgtggggcttcggacggcctccagcatcctgatgggggctggagtgtccccagccctggaggggtgggggagnttgatggttaacggagccgactgcggagggcgatggcccacgtctgggtgcggggcccacacccggttctgcgactcgaagaaacgtctctgcccctaggagtcccttggtgtagaccacagggttgctgtgaaactcagcagtgttaaactcgcctatgttacacagtacctggcgcggcgtagacactcagtaaatgttagctaatcttgtatgccaggagcattggccaccatatctaatgtaattacaaggcaaattttagccccttttttaccaaagactggatgaacccagtccctggtggtctagtggctaggag

SEQ ID NO: 904 - DNA, 1285 bp, Homo sapiens
  misc_feature: Incyte ID No: 477054.1
gtcccatagttcatgtggcaggatgccagggcatcaatcatggtttcaagatgcccaataacttcaaaggtgtatcccacgttgttgcctgtcatttctgacagcacctcactgatgggtttggtagagtccttgggaccagcgtggttgtatggaggaactcctacaaccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatatatctcaaaacagatatagcgtataaagatatagtaaatgcatctcctagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatatgg

SEQ ID NO: 905 - DNA, 381 bp, Homo sapiens
  misc_feature: Incyte ID No: 002966.1
ttaactttgccatttctaagttataggaaatttaccttctcttaattctaccactttttacttgactagacttgttaagggtatacattttctgttcagaaaactagtgtttttattggcttatctattgtgattttgttttaaaatatgttaatttctcaatttaggcttattattttgttttctgtagtttttttgactttttgagactgatgcttattttttgcttgtatacaaatgaatgtgttgaagacttttgaactgtcctttgagttcaaatatgttcacatcccagccattttgatatgtagtagtcttgttttctaagtagtatatcattgtgttttaaatttctggttcaataattaagtttttcaaaat

SEQ ID NO: 906 - DNA, 558 bp, Homo sapiens
  misc_feature: Incyte ID No: 136212.1
  unsure 475: a, t, c, g, or other
cagaccctcagcattttggaataaaaccatattatctcttcatgtagcaactcttctgttgagatacacatttgtcactttctactgggtcttagtagagactgaatgcttgaccctgggccacaaagttaccatgcaactgagcttcccatcataaactgatactgccttatcacccaagccataaaattgggcatgcacagaagttcttcattaccaaatagaagtgatatatatgagattggggtcaagcagggcccgaaagcacaagtaagttgcatgaggaagtggcccagatgcctatgacccctattcctactacactgtcttctctcaacctgtggcctcacaaggagctctctatgaccagctcactgaagaaaatcttggtcttgtattttactgataattctgcgttatattcaggcaccatcaaaaattatatggctgctacactgtagccctattccagatngccctgaaaaaaataatgaagggaaatcttcccagtggcaaaacgttgggcagtgcccagaaggagagacagcaagagttatg

SEQ ID NO: 907 - DNA, 5923 bp, Homo sapiens
  misc_feature: Incyte ID No: 977975.1
ggctggtacagccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcac

SEQ ID NO: 908 - DNA, 3693 bp, Homo sapiens
  misc_feature: Incyte ID No: 1505038CB1
cgatcggcggactcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcatctcagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgctcccaccctgccacatactagatgcagcccatagttggcccccctagcttccagcagtccactatctgccagaggagcaagggtgccttagacctaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgaaaaaaaaaaaa

SEQ ID NO: 909 - protein, 308 aa, Homo sapiens
  misc_feature: Incyte ID No: 1505038CD1
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIISDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 910 - DNA, 1769 bp, Homo sapiens
  misc_feature: Incyte ID No: 262830CB1
tgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcaattctcattaaacgtggca

SEQ ID NO: 911 - protein, 372 aa, Homo sapiens
  misc_feature: Incyte ID No: 262830CD1
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 912 - DNA, 2858 bp, Homo sapiens
  misc_feature: Incyte ID No: 3607580CB1
gaattcttgttttacaagccatggctctgtttcttaatgttttctataatcactcactttttttttgcttttgacaaacattcaaaatgctaatgattcaaggatgtcctcagctctgtatgtgttctaagagttctatgttttttctccacagaaggcataagaactaggagctgctgacatttcaatatgaagggcaactccacccttgccactactagcaaaaacattaccagcggtcttcacttcgggcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttccccttgtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgctattttggaattagaaaacacttactgaagacgaatagctatgggaagaacaggataacccgtgaccaagtcctgaagatggcagctgctgttgttctggccttcatcatttgctggcttcccttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccggttccaacagaagctccgcagtgtgtttagggttccaattacttggctccaagggaaaagagagagtatgtcttgccggaaaagcagttctcttagagaaatggagacctttgtgtcttaaacgtgagagcaaaatgcatgtaatcaacatggctacttgctttgaggctcaccagaattatttttaagtggttttaataaaataataaaatttcccctaatcttttctgaatcttctgaaaccaaatgtaactatgttttatcgtccagtgactttcaggaattgcccattgtttttctgatatgtttgtacaagattttcattggtgagacatatttacaacctagaagtaactggtgatatatctcaaattgtaattaataatagattgtgaataatgatttggggattcagatttctctttgaaacatgcttgtgtttcttagtggggttttatatccatttttatcaggatttcctcttgaaccagaaccagtctttcaactcattgcatcatttacaagacaacattgtaagagagatgagcacttctaagttgagtatattataatagattagtactggattattcaggctttaggcatatgcttctttaaaaacgctataaattatattcctcttgcatttcacttgagtggaggtttatagttaatctataactacatattgaatagggctaggaatatagattaaatcatactcctatgctttagcttatttttacagttatagaaagcaagatgtactataacatagaattgcaatctataatatttgtgtgttcactaaactctgaataagcactttttaaaaaactttctactcattttaatgattgtttaaaggtttctattttctctgatacttttttgaaatcagtaaacactgtgtattgttgtaaaatgtaaaggtcacttttcacatccttgactttttagatgtgctgctttgatatataggacattgatttgatttttattattaatgctttggttctgggttgtttcctaaaatatctgggtggcttaaaaaaaactctttaacttgtaataaacccttaactggcataggaaatggtatccagaatggaattttgctacatggggtctgggtgggggcaaagagacccagtcaattacatgtttggtaccaagaaaggaacctgtcagggcagtacaatgtgactttgaaaatatataccgtgggggtagttttaccctatatctataaacactgtttgttccagaatctgtatgattctatggagctattttaaaccaattgcaggtctagatacctccttctcagcactattaaagctcctaagttagaggagtgcctaaaactgagttacctaaagtttacttacattaaagtatgaatattaattttagaaatttgagactttattctgtaccagccctgtataataacaggttatctaggaccttcctctgaggtaggtctaaatactgatctctgaggcggaactaacgttttggggactcagcatctctgccaggttccaggattatagacagaagagtcctgtcataccactttctggaaaagtcctaatttcatgtaatccttttattttcaataaaaacaaatagctaaatgtataaccaactatgatgttatgttttcaataattttgtaaaggagcggatgag

SEQ ID NO: 913 - protein, 363 aa, Homo sapiens
  misc_feature: Incyte ID No: 3607580CD1
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 914 - DNA, 304 bp, Homo sapiens
  misc_feature: Incyte ID No: 137742.1
ccgctcccagccgtgatttctgacctatgtatgttaacattaccagttccttggctcctcactttttatttggattgtcactctagttgcttaatttcctcatttctatttttactctttctccagtttatcttgctgtctagtacccttctaatatttctaatgtactgcttttataacttttttctgttcttaaattaacaattgcttctgtttacctttcatttccagttcagatctgtcctctatagtctgttctcacttaacctccccatcatgcattctctttttcatctagaccctg

SEQ ID NO: 915 - DNA, 3857 bp, Homo sapiens
  misc_feature: Incyte ID No: 1095839.1
  unsure 2040-2041, 2169, 2177: a, t, c, g, or other
ccggaagcactggcagatgtgtgcgtcttgccgccaggactataatatgcacacagtagtgaagtcagccttttctaaagactcttttcgcaccatacaaaagtctcaagtgaaaataaataggccaggatgacaggctccatagctgcatactccttgccacagcacagcacagcacagcacagcacagcacagcacagcacagcacagcacagcacagcacagcacaggacagcacagcacagcacagcacagcacaggacagcacagcacagcacagcacagcacagcacagcacagcacagcagcaggctggcttctatgtcccatcactctcgtagtcttctattattatgttttcttccatgtctccttgggctgaaaagggctggggctggctagcaggcagttcactggcactattctgactcaaaggaagagaccaggtttccggcacagtggcttgagtgggttcacccagagattcctctgcagaatgtcctccattaagctgggcttcatctccgctgtcagggtctatcattccatgttccctgtcagtcagggcttccattttcaatcttccaaagtgtcgcttcagagggagccttccaatatcttggataaaagaaatctgagcttgatttctcattggaatggttagtagaagcaggtatggcaatagctgagtttggaggcataaagctggtaggcagaagtcaggaaaaagtgcttttgctgccaggcaattttcccgatactttttatttattagaaaccactgaggtttgtgcaagggtcgaaaacttgatcctcctccttggcaatgagcatatcctcgggctttgttggaatgcatcacacctctcgtagctatagatgtgctatattccctgagtaaagagcgtgtattccagtcaccactgaggatatctgcaaaactcagaaattcactggctctcacaatatcatcaatttccatgaagaaatctatgtagttttggtgaagatataaattaaataagtctccaggcatgtgtgacatttctactacctcctcaggttcaacaagtaatgtatcccgttcatattctgataaatgagagggcaaccgaggtgagtctaattctgttaaagatgctcttttacaatatagaattttccccaaagctctgaagagaaacagagaaacatctttgccaccaatagcttggacctcttgattttcaaaaaccctatcaggtttttttcttcgttttgattttgacagcacagcatctgattttaaagacattccttttttccttggccgtaagttgttttctccttttgaagaagaaaactggaggctgtttattgcacttctgatatcaccagaacatccctgacagagcaactctagagaagttttgtcagggacagtaatttttcctccattcttgttagcttctatagtcactattcgattaagaaatttcatcataattgttggtgccacagggttgaaactaatatttgagatagaacactcttcctgaatttctttgggaaacaataacctttgattattatctccactgagactgtccgagattataaatataagaggacatcgaccaatcctcacatacttccttagaacttcatgtaaagtatgagaatcccgataaaactggttaggtaaatcttcaaccagaattatcttcttatcagttctcagatcatctccaagcatttgtaacttgttatactttgtcgctcttagtagaaactctttgaaaactgctatctgagactgatagggaaacatatggaagcttgattcagtattaaacatccccttgaaatcatctttttggaagtctggtaaaactggattaatccactcttgtacttgaataccatgctcctttgatagtatttttaaggtcgttgtctttccacatccaggaggacctgttattaataaaatagatccaccctgttttggttgcctttctaaaacttgagcttttaaccaggtttcgacttcttcaattnntctttttatgcacagcaagttcatgctgattcatttcgtcctcatcaaaagattgtgactggtactataatcttggcccctttcctctatatttttgagagtatgaaaatatctttcattatagtaanactttcgnacagcaattctgatttgcaaattatttatacattttatagtttcatttcttacataaatgtggactcccatatacttttgtcattaaaatcaggcaattctatttgagcaatttttatactgaaaattaaagttttccttatttcaaattacagttgcaggtcttcatttccagtatttcccaaaaaagtaaaataccatgaattcacttgctcctttaaaaagcagataactgtccctgaagatgcgaggttactgaaatgagatgtcagaggtagaccttcaagactattcctagccgacccaccaccaccccacacagtgaacagggaatactaagctcaaatattcgtccaacgtaatcctgtaatcagtggggtgccgggttgagctcgcaaatccccgctgcaggacagggctctgcaccctcaatcttctcatccccagatgggatgggcgggtcgggaggaggagcgacgagagcccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaacttttgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaaa

SEQ ID NO: 916 - DNA, 749 bp, Homo sapiens
  misc_feature: Incyte ID No: 205328.1
  unsure 446: a, t, c, g, or other
aaaataccaagaaaattgtaggtttttattagctagtaatagaggctagacgatggaaatcagataaaatacaaattcaaaagaggattatttaaggaatctagaacaatttgggtaatgattgtttaaaatgtctgttgttgttgctgtgtgacttttaaacaatgtattttaacggaaaatacatgcatctgggaaaatttcacaagatattttatcgaatgttagtatactctacacgctgtcctgcaccttgctttttttactctatgcgtcttgcagatcattttatataatacatagagaggtgactcattctttttaaaggttacattaagtttgtagtatgtcagaatggcaatactataattgttttaaccagtgacgtttaagttgtttccagattttttgatctaacaaataatgtgtcatgagtatagaatttntatgttcatgtactagtatagttataggatgactcatatttgaagcaaagtacaaaacgcatgctttctgtagctactcataaattctagtatgagcaaaatgtcaagatgcttgcttatcaccgaccaagtgatgattaagctcttgctaaactgtatcaaaggagaaaaagggaaatacaggcttatcctaacaatttcacagtgaacagtaatctctggcattcagttaaagctagacttgttctaattactttgattttgaaattcttattaaataaaatcacaagccttttctcacca

SEQ ID NO: 917 - DNA, 1512 bp, Homo sapiens
  misc_feature: Incyte ID No: 252649.14
atctagaactagtcccagctccttcccgggcgcgcacacgcgcttgcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtcgctgctgcagcggtatatggagcggcgcttcccggacacggtcagcacggtgggcggcgccttctacctgaagcagtggcgctcctacaacatctccatctgggacaccgcagggcgggagcagttccacggcctgggatccatgtactgccggggggcggccgccatcatcctcacctatgatgtgaatcaccggcagagcctggtggagctggaggaccggttcctgggcctgacagacacagccagcaaagactgcctcttcgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaaatgtgctttgagaccagcgccaagaccggctacaatgtggacctcctgtttgagaccctctttgacctggtggtgccaatgatcttacagcagagagctgagaggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacccgcagcagaatgttggagtggaaatgatggctggctatgaagaggaggtcaacgtgtgtggtctcctcagtctctgtcagaggggtggggaggtgggaaacaggaatcctctgcaaagcccaatctgcagagtcgagacccctggtgctctctgccccgctgcctggcactggtcctttgcagccagccaccaacggcccccttgcccttgcagaggcagaagcctgcgtctgcacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaactt

SEQ ID NO: 918 - DNA, 494 bp, Homo sapiens
  misc_feature: Incyte ID No: 221762.2
ggggggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttgg

SEQ ID NO: 919 - DNA, 487 bp, Homo sapiens
  misc_feature: Incyte ID No: 138205.1
  unsure 7, 15, 19, 32-33, 35-36, 40, 46, 64, 71, 73, 77, 81-82, 97, 111, 115: a, t, c, g, or other
aatctcngtgattcngccngtaagtgcctatnntnncatnttcccncttttctattgaaatatnggtattncnctanattnnttatagaggtgcttncatatacatagttnacanattctctcatagtaagagatatgtagtaaaactattttgctagaagtgaagactttaaatttaagttagccaaattaatcaatttttttcaagggtattgattttttagtcttgcttaaaaaggcaaaatggaggcatacattaggtaaatatattgagaatgggaatttgaatcagaaagaaaaggcaacgatcagttggaagtatctgaatacatattgcctaatgggcatgtcctctctctgacaaaaagcctgatctgactgcaaatgaggcaaattgtggcctgtagcagcatgaacctccttctccaccaaaggattgctcagtaataacagtctagcagaaactcaccttgaaaaaaaaatgtag

SEQ ID NO: 920 - DNA, 5901 bp, Homo sapiens
  misc_feature: Incyte ID No: 331566.1
aaaaaatgttttgtagagacagtctccctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaa

SEQ ID NO: 921 - DNA, 3583 bp, Homo sapiens
  misc_feature: Incyte ID No: 1384719.3
  unsure 3245, 3265: a, t, c, g, or other
catcctgagttcttttgaagctgatctcaggcatcggattatttcttctgtaaatatttcagaatgtatctctccaagatgagagctcacttaaaagacaattacagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacactggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggaggccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtanatatatatacatatgtttangtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctc

SEQ ID NO: 922 - DNA, 237 bp, Homo sapiens
  misc_feature: Incyte ID No: 1330137.1
  unsure 139: a, t, c, g, or other
ggtctttctatctcttgtactacactgaattcacccccactgaaaaagtgtctttttcatagatcgagacatgtaagcagcatcatggaggtttgaagatgccgcatttggattggatgaattccaaattctgcttgcntgctttttaatattgatatgcttatacacttacactttatgcacaaaatgtagggttataataatgttaacaggacatgatctcttataatctacttg

SEQ ID NO: 923 - DNA, 575 bp, Homo sapiens
  misc_feature: Incyte ID No: 409962.1
ggagagaatgtctcaactttttaatcactggttctcctttatattcctcaaggtggaggctgtctgcagtaggagcatggagaccaacaatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaccaccccatgtttgagtgattctgtatactgatagggaatatcaagagtgttactgggttttgtgaatcacgggccttgaaagtattattaatgaataaatgacataatcaatagacaaggtagaaatgaatagcaaa

SEQ ID NO: 924 - DNA, 2802 bp, Homo sapiens
  misc_feature: Incyte ID No: 481118.7
  unsure 1873, 2029: a, t, c, g, or other
ccacccgggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaacgtcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaanttaactataaaacagcctcaggcaggtccttcaggagatattccagaagagggcattgttatcatagatgacagctccattcatgttactgaccctgaagaccttcaagtgggacaagatatggaggtggatgacagtggtattgatgatcctgancacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgccctgtacaggtgtaccatttttttaatccattataccatatttttattgtaccttttctatgtttagatttgtttagatacacaagtaccactgtgttacagttgcctatagtactcagtacagtaacacactttacaagcttatagcctaggaacaataggctataccatctaggtttgtgtaagtacactcttatgatgttcacacagtgacaaaatcgcccaaggatgcattcatcagaacacattcccattgttatccaatgcatgactgtataatggttttatggattaaattttttatgtaattcaactggaaagtatttttatgttattttggaaaaaataaaacaatgacaattgaaatc

SEQ ID NO: 925 - DNA, 3135 bp, Homo sapiens
  misc_feature: Incyte ID No: 481118.12
tgctgctgtgtctgtgacatctggtgctgctcatccccatccacaaactggaaaatgatttcctatgtaatcatgcatccaactgggctgtgctatttttttaaatgaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagattatatgttcgaatgtttcttgaacacttttatatttatcagtttaaatattacattttttgcccaattttttttaaaatttttaaatggtagattatatgtcttaattttcctctaaagcccaatttgattaaaagtggtttgtgaacagtcattggcttccacccagcataagtgccttaggaataagatcataaaagttgaataggagcccattttgcttatttctccattattttttacctcattgctagcatagccataaaaagctttttaactttaaatatttacaaggcccttagggcctgtattccacgcaaggggtaaatcagaaaagaaaaaaatccttttagcaaaaacatagcagtagcagagaagcacattgtaaatctggcttttctttagggaaagaaaattgggagactctcctagtgtagcagatgttcagtccagaaggcactaggcatgtcgttaaatctgacctgcatttcttcttaccacctcctgtgccttgatgcttctctgatgacccctttctcagagtctgaataaataactagaccaactagagcctggttttactaagaataataaattccagcagctagagctgaagaacaaagagacttggattataaagatcctccccaaattgctgaaaatagtgtggtatattctttgggagacagatagagataggagtcataggtactgggtttatgatgtcattagagtatgcagtttaagattct

SEQ ID NO: 926 - DNA, 1310 bp, Homo sapiens
  misc_feature: Incyte ID No: 337528.4
gctgggtggagggaacgactcggcagcctcttctggccctgaggaagacgtcgatattttggcacgaggggagccactgaaggactaccctacccttgcgagggaccgcaggaggtgacgcccctgggcctcggtgggcgcttctggcggttttcgatgtggcaacccccatcagccaggataatgatgagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggatttacgtgggcagccccgtggtggcgaacagaacatcacggcggaaacggtacgcggagcataagagtccaccgaggggagtactcggtatgtgacagtgagagtctgtgggtgaccgacaagtcatcggccatcgacatttcggggacaccaggtcacgggtgctgggggagatcaaaacgggcaactctccccgtcaaacaatatttttatgaaaacgcgatgtaaggaagccaggccggtccaaaaaccggttgcaggggtattgatgataaacactggaactctcagtgcaaaaaatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatcagatga

SEQ ID NO: 927 - DNA, 1309 bp, Homo sapiens
  misc_feature: Incyte ID No: 3687719CB1
ctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaatctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggccacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtccctcaccctccgggctgagcctggctctaggacctgaagaactctcgaaggacccagccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgaaaaaaaaaaaaaaagg

SEQ ID NO: 928 - protein, 330 aa, Homo sapiens
  misc_feature: Incyte ID No: 3687719CD1
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 929 - DNA, 867 bp, Homo sapiens
  misc_feature: Incyte ID No: 332299.1
  unsure 555, 861: a, t, c, g, or other
ataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgttttgctgcacacagggacaaaagatataaaaatggatcataaacatttttctaaatcctgaaaaatgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagancctatcacattaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaatanagattt

SEQ ID NO: 930 - DNA, 4874 bp, Homo sapiens
  misc_feature: Incyte ID No: 1530186CB1
  unsure 4822: a, t, c, g, or other
ttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagttattcaattcctttatgagtgaatgtttttacttttgactcctaaataggaaaagattatttgacagctggaaaataacctgccaccaattaagcgagtgacataggggctactttgtcccaaanaaacctcgaatggatgttaccgatcagttcctaaggatatgcattttgagtc

SEQ ID NO: 931 - protein, 541 aa, Homo sapiens
  misc_feature: Incyte ID No: 1530186CD1
MDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 932 - DNA, 285 bp, Homo sapiens
  misc_feature: Incyte ID No: 251809.1
  unsure 2, 71, 198, 240, 245, 249, 263: a, t, c, g, or other
gnagaaacttcgagttgaaaatgctaaactgaagaaagaaattgaagaactgaaacaagagctaattcagngcagaaattcaaaatggagtgaagcaaataccatttccatggtcacgctaattctatggtttctgaaaatgtgatacagtctacagcagtaacaaccgtatcttctggtaccaaagaacagataaanggaggaacaggagacgaaaagaaagcgaaagagaaaattganaaganaggngagaagaaggaganaaaacagcaatcaatagctggt

SEQ ID NO: 933 - DNA, 497 bp, Homo sapiens
  misc_feature: Incyte ID No: 334025.5
ataaattgtagtattacacagattatgacttaccctttagaagaagaagggcagatctgtaggtactaccatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataattaaaaagttttggtatggtaaaaaaa

SEQ ID NO: 934 - DNA, 701 bp, Homo sapiens
  misc_feature: Incyte ID No: 350134.1
ctttcccaaccagcaaggacacaaccatacgagccccacccacgcggggtggctgccgtgctacattccgcagaaaacaggcgggaaagctgcggcacagcccgctttaaacgcaagcttttgggacttctggttttggctttttctttttaagccaagttagggagaaggctgactgccatggagccacttctgcttttggcccagacaacttacgggattttttttttcctcccatttagagattttttgtaggaagttaacaaattattttaaagaagtagttagggcttgtcagataaaatacaggacgcccagttaaattggaatttcagataaccagtgttttggcatatgtgtgttacatatatttttaaaattgtttatctgatattccaatttaactgcacattctcaatttttaatgactgtatctggcaaccctatcagcctttacccctgaaaatccagactgcttatgacaaaagtaaggaatggagggaaatgaaaagcatgtttacctacaacttagaattgtctttgcccagactttgatccttcatggaggccagagggccgtggtctagaacaaaatttggcagcaactcataaagatatccttgtataattccctttctggcaaagtaagattttttttttcttaagctatcacgatgtaattttggacaacagatcctctt

SEQ ID NO: 935 - DNA, 391 bp, Homo sapiens
  misc_feature: Incyte ID No: 016124.2
  unsure 379, 385-386: a, t, c, g, or other
agcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggatataagaataatattgccaaacttgtaagtgaaatgnaaatcnnagagg

SEQ ID NO: 936 - DNA, 500 bp, Homo sapiens
  misc_feature: Incyte ID No: 140468.1
  unsure 346, 359: a, t, c, g, or other
cccacgttagtgcagctggggctccttaaatattccttcctaagtcatgtagtacacattttagaagccacattaaagtaccaaaattacccacaaaccgtttattgctacagttcactcccgtattttcttctcaacctgtgggtaaagaaagacatagataaattcatctgatgctttaaagtggcagagctataaatatctgatttttctctgtgttttgaaaaattgaatagtcatagaaaattcttataacagtatttacataagtgagcacttcctctttcctttcttccccctcgctctccgtatccttcctccttccttccctccccctttccttccntccttttttcctnccttctttcctctctttctttactaaatatccatattatgctaggtattgttttagattccaagccagacacaaaggtaaacaaaatatagtcattgctctcaaatgtctcacagccttctgaatcttttgaagaggaaaa

SEQ ID NO: 937 - DNA, 1492 bp, Homo sapiens
  misc_feature: Incyte ID No: 3257507CB1
cccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaa

SEQ ID NO: 938 - protein, 318 aa, Homo sapiens
  misc_feature: Incyte ID No: 3257507CD1
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 939 - DNA, 979 bp, Homo sapiens
  misc_feature: Incyte ID No: 1400580.1
cttttgtaataaaaatcagataaattttaaccatgactcaaatattagtaaacatcatagtactcattttctagaaaactattacaattgtaatgaatgtgaaaaagtattttaccaatcctcaaagcttattttccctgaaaatatccatattcaagaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacaggt

SEQ ID NO: 940 - DNA, 3172 bp, Homo sapiens
  misc_feature: Incyte ID No: 481154.3
gcatgggataaattatgcgaactggttagaatttcatagtctagaagtatatcagccaggcagcagcccaaagcccacataatagtaactccccactttgccacccattcatgtgtataacactcctcagatattcagagtagattgggaggcagaggtcattgaggaaattctcagtgtttaaggaaccaaaaaagataaagattttaagtgaagatacaaaaattttggaaaaataatataattactctggtgactaatcttaaggggaaaaattaggcaggcactagtaactgttctaaaaactaagctcaccaacatcaaagttgagaaactcaggtcagtttcaggaggctggtcaggacgagggttgaatcacaggagatggtagcaaattgggatctgcacagaaagtagggaggctgggcaaattcctgccttccgtggcactcagtggagataccctccaagtcccacccatctgtggtctttacccactgctgagatcattgaatttatgactatctcttctgctgcatggttagaaagcaagaataggtaaagccagcatggcctcaaaataaggcaagtgtgtgtgtgtgtgtgtgtgtgtgtgtgtgtgtgtgtgtgtgtgtatcccctacagagaaatgggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagacttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaatggacacagtggtctttgtttaataaagaaaatacaaatactgttcaaatatacacactttaaaaagaa

SEQ ID NO: 941 - DNA, 7055 bp, Homo sapiens
  misc_feature: Incyte ID No: 346716.17
atgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacagcccgagaggaaggcttggagttcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcaattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtggcacttcctgcagatgaagcgggccgccgtcaccatccaggcctgctggcggtcctaccgggtccggagggcgctggaggacgcaggctgccgtgtcctccaggccgcatggaggggctactggcagcggaagctctaccggctaccagaaacagagcatcatccgcctgcagagcctgtgtcgggggcacctgcagcgcaagagcttcagccagatgatctcggagaagcagaaggcagaagagaaggagagggaagccctggaagccgcaagagcaggcgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctaacaagagccccaagacccgagagcctgctggaggagcgggccggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggcagaagtgtcccctcgggacggacccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgaaaagagtctgccgcctgcagcaacagggcctggagctgatgggcagcctgcgccaccctggatcaccgtcactcggcagaagcggagggggaccttggaccagccacccaaccaggaagacaagcctggggcacggaccctgaagtctgaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggcagctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaac

SEQ ID NO: 942 - DNA, 1117 bp, Homo sapiens
  misc_feature: Incyte ID No: 346716.21
aaagagtctgccgcctgcagcaacaggcctggagctgatggcagcctgcgccaccctggatcaccgtcactcggcagaagcggagggggaccttggaccagccacccaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatga

SEQ ID NO: 943 - DNA, 2609 bp, Homo sapiens
  misc_feature: Incyte ID No: 1384720.16
agcacaccttctcgttgatgtcgcgcacaatctcctgcttggccgtgatggtgaagcttggtgaggatcttcatgaggtagttggtcaggtcctggccagccaggtccagacgcaggatggcgtggtgggagggcatggccctcgtagatgggtaccatgtaggtggccctgtctccagagtccatgacagtgccagtgatgcgcccagaggcttagagggacaacacggcctggatggccacgtacatgggctggggtgttgaaggtctcaaacataatctgagtcatcttctctctgttggccttggggttcaggggacgatgccatgctcaatggggtacttcagggtcaggatgccacgcttgctctgggcctcgtcgcccacgtaggagtccttctggcccatgcccaccatgacgccctggtgtctggggcgcccgacgatggaaggaaacacggctcggggagcgtcgtccccagcaaaaccagctttgcacatgccggagccattgtcaatgaccagcgcggcgatctcttcttccattgcgaccggcagagaaacgcgacggcggagcggcggaaggtggacagtgaggccaggatggagccaccgatccacaccgagtacttgcgctctgggggtgcgatgatcttgatcttcatggtgctgggcgccagggcggtgatctccttctgcatcctgtcggcaatgcccggatacatggtggtgccgcccgacagcaccgtgttggcgtacaggtctttgcggatgtccacgtcacacttcatgatggagttgaaggtggtctcgtggatgccgcaagattccatacccaggaaggaaggctggaacagcgcctccggacaccggaaccgctcattgccaatggtgatgacctggccatcgggcagctcgtagctcttctccagagaagaggaggatgcggcggtggccatctcctgctcgaagtccagggcgacgtagcacagcttctccttgatgtcgcgcacgatttccccgctcggcccgttgttgttaaacctgtagcctcgctcagtgaggaccttcaacaccccggccatgtacgtggccatccaggccgtgctgtccctttacgcctctgggcgcaccactggcattgtcatggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtaccgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcaaggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaaggaaattcagccctaaaatgtatttctctctgtgtacgagtacacaatcatgctgtttattaaactatcttgcttacatctttaagtattttttatttactttattagtaacacttatttgaaaaagtaattgggagagaaaaatgtgttggatttatgcctctgatgtatcacatgcaggttgtcagctctggttcaagtgtgtaatctctatacattgctgacaagcgagagaacgagaaggatataaatggagagtatgtgaatggattttattttttcaagcccctgtgtgagtttgcaactgtgctggtaaggaccagttctttcattgtg

SEQ ID NO: 944 - DNA, 1281 bp, Homo sapiens
  misc_feature: Incyte ID No: 1505790CB1
gccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaaaaaaaaaa

SEQ ID NO: 945 - protein, 289 aa, Homo sapiens
  misc_feature: Incyte ID No: 1505790CD1
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 946 - DNA, 2423 bp, Homo sapiens
  misc_feature: Incyte ID No: 3876162CB1
ctcggaattcggctcgaggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaatttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaaaaaaaaaaa

SEQ ID NO: 947 - protein, 610 aa, Homo sapiens
  misc_feature: Incyte ID No: 3876162CD1
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 948 - DNA, 1469 bp, Homo sapiens
  misc_feature: Incyte ID No: 040576.1
gcatatttttaataaatagcagtctgtgttcccactgcagacaactgaaccagagtttctaaggatggggcaagggcttgggtattttgtaaccatgttgtggttatgcttatatgcagcccaggttgaaaagcatgacgtagttcttgcacatcaaagatttttattttgatttttttctttttgtattcttttcaacattgtattaacatacagtgcacatctaagatttaaagatcttctgagacctgttaccttaaacttttgctccatttagtaaagctccttcttccagccagcttgtttcagaaactacacaaatcatgaattagaacaaaaacatgtatacaaaacctttgattgttagttggatatctttgctatttcattatttactaggcgttgtatggcttttagtgtgctcattttacccttgtgcttatgtctgatcagctatttgacagcagatactcttctagatttgaaatttctttcaatcttttttgtagataagtctagataagtgaagcagtgggaatgcagaaggaacaaagaaatctgtaactggttgtgaggtgtaaacatcactgcactcagaccatagatttgaagtttcttaacctcaaaactctattttagctccaactagtattattttaaaataggtggtttagcaacacatatatccaaaaatggttagattctccagatatccagaatctaaaccatcatcagagtaaaaaggtaagaatatacttcaaagttttctcaagacaatcctggccagaatgcttaagtttgagtagtcaaatacttaacaaaatgaatataaaaaatttagcactagcaactaatcaacaaacatgaatataaatgctttagtatgaagaagccattgatagttgtaataactttgcattgttaattggtatcttacaaattacaacttattatgcaaacaaaattatgttggtctataaatattggttaaatgaacatgtttcctgtacatttataaattctccatatgaaaaatactcatctgaaatgctaaaagcaaaaatgttatcagtagaaaagcagctattttatgactttttaaagcaagttatgtctgttatttttcacctgtttcaaaggaatgcataagatgcttttataagtgtttttgttcatgtataacatacttagcacttactacagatgaatgctgtagactacttaatttcaaatgcctacattttcaaaacaatgaagacatattactgaccataaaatggaaatagcaaccattcaaaatagttgaacatttattgtgtcatttactctacggaggcaatctcattattaaagaagttatagccagtttatgtgcatatgtaggtgcaagtatctataatgtacattataatttgtaactatcaaatatgtaagtgtaatgaatatcggtttattttgaatacaagctt

SEQ ID NO: 949 - DNA, 1467 bp, Homo sapiens
  misc_feature: Incyte ID No: 1040190.14
catttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaatacaagcaaaactaaagaactgcagtcttctgatctttatttctgaagagctagcctttaacatatatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaagggcacaccatgcgctcggcaaccattcaaatgcaggaattaagcagcaatggctgcagtgtccttctcagttatggaggacatcgtctcattagggaacttttacagttcaaattaatttgcagaagttgccataaatgtttgcataatgacatagctttaagcactacatgattttaatctgctcacattataacaggaccaaatacacaagagcgtaatcaaatcatctgtaacttcttaattacagtttacctatttctgacatgcagcactgccatctcttccagcaccatcagggttttaatggccctctagaattaccactgagatacactatttgatccatggataaccggtaatgggaaaatgctccgaccctcaatgcagtaaatatttacttgcaggcaactgggttctcatctcttgatttgcttttgtaatcagcaataataaaatagcaggtagatggatgacagttgctcattctgagaaacttcactcttttcacttatgcatcacgaggaaataactaaaatacataccaagagaaaaataccttgccatcggatcatcaacaagtcttctatttacaaacttcaaaaaacacaaaacaacattcatgttttaaatgctttctacttgtggttcaagaagcactagatttagtaagaaactctacctatatacttagtttgaagttagtaacttcctgagatgctaaagacttacagcctgcgattatacaaggatttacacatgcttcctctggtgctttacttcccaaacctaaaaaagcaatgaaatagatgtaaggaaggagggatttaaaccttttaaaaaacttttgctgacttatattactgtaaagatttgtttgctcaatagtaatcgattaaactacaaagtatttcc

SEQ ID NO: 950 - DNA, 1297 bp, Homo sapiens
  misc_feature: Incyte ID No: 1328310.1
caggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatcctcccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaacc

SEQ ID NO: 951 - DNA, 707 bp, Homo sapiens
  misc_feature: Incyte ID No: 034297.1
aaagctttccatggctaacacagtaaatttaaataaagctctctttgtctccttcaaataacctgtgcgtggactttaaaaaaaaaaaggacactccaaatatcaaatcaacatattctgaatataaaatattcagtgaaaatttattttctgaaatgatgtttaaaatactcgttaaaacataaataaaggtgacaatctaagtaggatttaggactctgaaaaacctggttttctagattagtcatcactgtgaaaagtgtgactctattggcataaccatcactcaaatgttcccataaatctgccctataccacctgtacaagacaaattccttttcaacttcttcgtggaagtttagtttggttaacaaatagaaagatgtaacgagccagggtctcctttgtaagatacttgtgacaaagaaacccttcctccccataaaggaagaggaaaaaatgcaacatccacagagacttatagagattaaaagaaaaaattccactgactcttgcttgtaggagggtgaaatgatttgacttgttagatatggatgcattgctgtatgtgaatttttatcaaatgatcataaacctaagtccttggagttcatagtacaatacactcttgcccatttccatgctcacccaacccatgaaggaattccttttaaaagatgcatgacaatcttaagtgagcacatact

SEQ ID NO: 952 - DNA, 377 bp, Homo sapiens
  misc_feature: Incyte ID No: 145549.2
aaagaaaggaaaaaagaaagtgaagtgcttggaacaaggcctagcacatagtaagtactatataatgtctattttgatgaggctggaaggattctatcctgctgtttgatatttgaatcagagtcttattcctgaccagaagcacagaggagggatttgagccaaaggatagagcccctgtgccacagagttcacagtgaaaataaagggaaaaagaaagacccctataaagccagggttatagaaataggctcagatggggtctagtggactttgatgtgtgtgtaggaaaatattaaggtgggatgtgtggatcagtgtcctagcacattcccgcagggtgtaagcctggcactatcatacctctggtacgtaca

SEQ ID NO: 953 - DNA, 701 bp, Homo sapiens
  misc_feature: Incyte ID No: 042206.1
  unsure 72: a, t, c, g, or other
ttgtgcccctttaatcttaataacaatgaaaattattatttaactttttttttttatcttgtaacgtatgcnaggccttctgctaagcactttacatgtcttatttgccacttggaaaatagccagcgttacctgtagtgtagaaaggcaatgagatttgtagtatagaaaggcaaggagatttgaaggttttgcattaattgtcataagtgagtgctaaagaatcaaggaaggacattgataaattactgctgagagttctgtaatccagagaacaggcagtgcattagtggaaaaatagaattcattatttgtggttaaaatgaagtgaaatatggcgggtctgaatgcagtggtgcttacaactaattgatcacaaccagttacagatttctttgttccttttccactcctattgcttcacttgactagtcataaaaaaaatgatgtgaaacgtaattctaggggtgaaaaaagatttttttataaccatgatccgttactttatagaaaatttggttccaataaccgcttttcaagtttttgttcttttcagttttagtacttattagtcgccactgccattataatataagcttcccaaaatgtaactgtcattgtttcacatcccctgctgatctgcagcactccccggcgcctaccaaattaaggaatgcctcgcccaatgttcagctgagaca

SEQ ID NO: 954 - DNA, 824 bp, Homo sapiens
  misc_feature: Incyte ID No: 178799.1
actataagtagatttacaggaacatatataggagtatatgatgtgcagggagagaagggaagaattaactttgagagctacttatttaatctggttaaaggcaaagactggtttctccttttagaataagtcattgatagcttcctcaaggagttaaaaattcagtgcatcctatagtgaaataaagggatctggaagtgtagaataaaatttatttttgataataaatgatgattgaagccctgaaagttattcaaatgtttttgaaatgattggataaaaagcacattgaatgatctgaaaaatataagaaagtacaggttaagtatttaaaaagggggagaaaaataagaggttgaatattgtcatgacttggtgaatttgaagaaactaattttgaaaagctcataaggataggagaggtgtagtataaaatgacaggtagggattgtaactttggtactactgttaagaattaattccaaaccctagacaataaatcaattacaaaaatgttataataatcaggggagaaaacaaccaggtcctagaccaagttaaaaatggatagagaaaagaaattcaggagattgataacaaaggaagcacagagagtggaatcaaatggctaataaattttctggaatttcttagaaattccatttaaccatatgatatgcttagcagaaattgaataaagattgttaccttcatgttatttttttttctggctcttaaaatgtgcttgggagacagaacaataacttaaaattacagcttagttgaacataaggaatttttagtttttgccttttaatttatgg

SEQ ID NO: 955 - DNA, 370 bp, Homo sapiens
  misc_feature: Incyte ID No: 214767.1
  unsure 324, 327: a, t, c, g, or other
gggagcgatttggctgtctttaaggggaaatcaatcttgcccaggatgggggtgaggaatataacatgatgctggcctattaaatgcagatatctgtggagaattcagaggagggtgacaatcggcagctgacatgaatatagaatagacaatatagatgtgggagcttaatccctataggtgatagctgctaatattagagtggatgagattcttcgaggaggctgttttatctttacttttgaaaggaaattttttgaacgtgccatatataaacaaataataaagaattaaaaaatcaaggcatatgtaaggacatctctnttngaatttccagataaaagtgtgaactccgatgttgtctttaaga

SEQ ID NO: 956 - DNA, 564 bp, Homo sapiens
  misc_feature: Incyte ID No: 094384.1
ctcctctccaccaggctcccacgcccaccacacagcctgtagccccggcggagctatgggctctgactccgcctctttccaaatccggagtagttcgtgccacagtcgtcctcggaaccctgtggccccttcctcacccgtttcagggccacttggttcccacctccaccttcttagtctgcctgccctgctttccatcttcttggaattcgccttgctgccgccccgcgcccacccccgcgcccacccctgcccctgcaccgtcccatgcccttatggatttattctttacacgtaaatatgtctttcctctttttgaaaggatttggagttggaacagagaaattcactatggatgatgctatatctttatatgacctttggaatatctgtaatcatcctgagggcaatacttatgtaatgaagatggaagaagagagaatatgaatactccgtgcactttgatcttatcgtttagctgctgatcataccatccctggagtcctacttctgactccaagttatgagatggaatcttgcactccagcctggggggacagagta

SEQ ID NO: 957 - DNA, 1930 bp, Homo sapiens
  misc_feature: Incyte ID No: 2852561CB1
ccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaataggtgtttctgccttcaaataagaa

SEQ ID NO: 958 - protein, 529 aa, Homo sapiens
  misc_feature: Incyte ID No: 2852561CD1
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 959 - DNA, 2719 bp, Homo sapiens
  misc_feature: Incyte ID No: 337058.1
  unsure 479: a, t, c, g, or other
ggttcttacattaaagttcatattttctgggatttaaggatacaggggtattttcctattctacttgagaagtagactaaacaatatttgcagtgatgacagacgcacacagaagaaaacattagaagagatgcctttctatcctctcatgtggttgagcattcttacagccaaatgactaaattggctgtaaattggtttctaggaggagcagctgtcactacgtgtgatgtataatatttagccagggccaactcaggggctgtgtcatttgtcctatctttaaattgaggtcagagtgtcacacacaacccctcccctggggcagggtggactggactaggttgcatacgctggctgtcagctcagcaaaaatgccacatggggcttgtcactccgccagacactcactgactcacgggctgccaggtcacgctcggttagcgctccagggcctgactctggattgaagctaaacntggccagaatccacctcacagccacaaccctggttctactgcctgtgaacaagacagcccagtcctgtgttgagtctctcttctcctggatgaccctgcaaaaggaagagaccagttgtactgtgggcttagttctgggtttccactgcacactgacacgtgccagcaagggtagctgtggaaaacacgtatcaggagagcagagtagtctggatgaatactctgtgctgatcagaacgggctcggtcataatttaggagtggagctgatgtgtctgtcctgcctcaatgcagaatattccaggcttcttgaccagggttatgttcacccatctcccaacacacacatgcacacatgaaaacaaaaacatggtaactcttttggttcggcacaccatacaaaacgtgctttggggcgaggagtgctgtttcttttaacacttgtagaggaatatcctgagaagtgaacctgggctttgggagagctcagctgagaattctgttgacattttctttcccttgacaaggcttcaggttcgtctcactatagggagctggctgtgaaaatcagtaataacttgtcaagaagcagtgaaaaatgcgggggggtggaaagagtctaggtaactaatgtcttataatgcatatgtatgtaaatattacaggatttaaggttgaattttttaaaaagaaagttatagtctgtaatttccatttgttataataatgacctttaatacttgtcatttggaaccataaagcatttttatcaggtacctctgttccaagggatttatgtcttagaccatagctgaattgaatgtttgcaaaacactgctataggataaggtggtctttagttttgaacgtgtgaaaggactgcacacttttcagccagggtttgagttactgcccagggtcatcgtctcaaagtaattcaaggagtgatttaacatcagcatttgaaatgtagtcttcatctcctgggatccataaaaaaatgtgaacagggaaatggtggctaagcagagcctgaaataataacttggcaaagaaatgagtttatcaggtcgagtcaaaacatggcatcccctgttacactcaagaaatgctttcttcatgtaaatgtttatacgggcatatataatcacaatgggaacagttaaaaccccctcccttcaaaaaaagaaaatctatatcagttgggtttggttttggttcttcattggcttcaaggcagttaactgtctcagtatagcctttggggagatttaacctcattctagccatttttccatcctgaaggccaagaaggactattagaagggtttttgaggggtttcggaggtgagggcccaagacccccataatgacatcattaggtattcttgaaaggtgttaacagaccagcacgctcgatgtgttgtacccttcatttatttttttttctcagcatcccaagttgtccatcagtacattccccttcaccttacctgatcttcatttaatgcccagtctgtaactaatgtgctgtctaaagctctcttaatttgttggctatgagttgatttgtgaagctgggatgtaaccctgagtgaggagaaaagggcattgagccagcataaatctgaatgggcagaagccacaaacaaatgggagcagaaaagaagggcgagctcccccgcgccggcaccccgtgtataatccagtgttaacctctgaggaacacctcggctctcccaactgaggagagacaaaagagggattctttttacacccaggctggcgcattttcaagtgacaatctcgggctctagttgcctttgagatatccacttctgctctttctcccagggctcagaccaagaaaaacatgctctcaagattagcccataggcagttcttgtgacctggctgaagaaagaaaggagacctgtttgttttaaaagtcgggcgcaaagtgtcaggtggctttgatttatgacagaaagaggaagaagaaagttggaggtaatagcactatccaaataaccctgcccaggaaacttgggggtcaagagagcttatcaagagccttttataggtaagctcttccgtgtgaaagagaaaaggccggaaagagggagagagcccagagagcaggctgcgaactcacttccaatgggattggagtctgttgtattcttaagagatagcctgatatgtggtttataggtgaatcaataaacaccaacaacaaca

SEQ ID NO: 960 - DNA, 2886 bp, Homo sapiens
  misc_feature: Incyte ID No: 988704.25
  unsure 17, 2848: a, t, c, g, or other
gtggcgtagagagttangtcctggtctgcgtggaggtcgacgactccgtcgcagactacggacctgtctgggtctcagccgccaaagaccccgtccggtaggtgagtggctcactttgagggcaagcctctcggatcgaggcttcttcatggccgctcagatcgtgagcggccggggctgctctctttgcggaggatggcgtctaatgagcgcagttgattcgaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccaattgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgttagtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcnaattaattttttgtactagaaaaaaattgaacatttag

SEQ ID NO: 961 - DNA, 1534 bp, Homo sapiens
  misc_feature: Incyte ID No: 988704.26
gcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaaccaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaact

SEQ ID NO: 962 - DNA, 412 bp, Homo sapiens
  misc_feature: Incyte ID No: 401906.2
  unsure 388, 404: a, t, c, g, or other
ctctgaaatggtctccttggatcatgggcagagatggtacgatgggatcccacccgaggggtcccggccggtgctcacggggctgggaccagctgctcttactctgtttttctacctttctcagccacttggaggaagagagaattttgttaccttttacaggcaagaccactgaagccctctggtcatcagcaggaatgcaggggcgcctatggcaggccggactccaggtcaggccttggggcagtgaggaagaaggtgcatgccaggagctgcctacgcgttctggaagaattcacatgctgatttgtaggcggcctggccaggtgcttcggagactccagcagcatcgaagctcagatactctgggggaagccagtcaccattncacgagggaagttcanctacccca

SEQ ID NO: 963 - DNA, 377 bp, Homo sapiens
  misc_feature: Incyte ID No: 154220.1
  unsure 349-351, 354, 370: a, t, c, g, or other
cagagttataagctttagagtattagcagatgtcattctaaaagttcctttctttagaatctaaattatttaaaaaacttaattttgtgtgcaggtaaattgcttgtctctgccctcatcaacatcccaggggcaggatttaaaaaaatcttcacgttgttgttttattttgtttcacttttttcttgcccatttctgatacaaaaatgggacaaagagctttctgatggaaagttattattagctccatttactagaaatgactcataggcccaaggaagtctttttgcatgtagtaaacacatagtaaccaaattaggtatgtgagccaaaggttaagaaccaaagnnnaanttccaggccttaacantaattgg

SEQ ID NO: 964 - DNA, 5129 bp, Homo sapiens
  misc_feature: Incyte ID No: 5371205CB1
gcgccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggagtatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcaagagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacatggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgt

SEQ ID NO: 965 - protein, 1588 aa, Homo sapiens
  misc_feature: Incyte ID No: 5371205CD1
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASKSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNMDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 966 - DNA, 393 bp, Homo sapiens
  misc_feature: Incyte ID No: 147026.1
ccagttcctgaactctgcttcttccaaggcaggtaaggcagttttgttcctctgctggaagagtaatttcaggcctccctgtgccacatgctggtccttttgcctggaatgctcttcctgtcttctctgctttctccttcaagttttagcttaggcatcgccttctccgggaagctcttcctgacccccattgctacccacagtgagtcacttgctctctgttcctcacttccacgatgtttcctcctgtctccatcattctactcattagcccaggtgggcaattatttgttgtggtgtttgttgtagacaaagacagtcttgtttttttggttttggcattttgctactaaatgtgtttttgataaatgaataaatataataacaccacaa

SEQ ID NO: 967 - DNA, 794 bp, Homo sapiens
  misc_feature: Incyte ID No: 410776.1
ctaaaactaggattgagcaagcatgcccagatataagatcaacctctgttgatggaaacctacatttgactaaagatcctcatcagcagtatggaatagttattttagttatttgtcactcaaaattttgctgtcttttttaagaaaatatttattattagtagagaaggaagtcttctgataaaactaggcatatcttttagggagatttaagggcattatgctcatatcactttgagttctgtgttttatgggtggggtaggaccacagtctggacgggactttatggaaacattctgaatcgtgagggctccctgagacccagttaagtattcgcccagtgaggtttttggccttctcctgtgcctttgcctgccttagctctctctcattggttggtgagtcaagttgatccttgcaagagctgctgtttattgtgtgctcatgattcagccaggcactaagtacttctcatgaattacttctgttccttacacgaaagcatgtaggaaatgagaggctgatatgggagctgaatctggggctgtcttactctgaggtctgggtcactccatataccatgctacctctctggttcactctagtaaatctagcttctaaccaaggtgttttcagttgttgatgagaaaagcctctctgtgtattgactccagaaaagcattgatgctcgtccaaaggtagtgagttagctcagttgattgttcacagtcagttacggatcgaacagtctcgttctagtctttcctcccttactattgcacttgactaagtc

SEQ ID NO: 968 - DNA, 374 bp, Homo sapiens
  misc_feature: Incyte ID No: 335121.1
ctttgctgtttttcgttaattcttaggttaattcccaaatattaggggattttccagataactttttgctagaatttggttttgttatttaatgtcatctgtgtggtctaagaatatgctctgcataaattcaagtttttaaaacttactgacatttattttttggcccagcatatagtttaattttgggggatgttatgtgtgcatttgaaaaaaatgtgttttctctcttgttgagtgttctgtaaatgacaataaggtcgaattagattgatggtgttgttcaagtcttttatgtcttaaccaattttctatatacttgttataccaattactgagagagaagtagtaaaatctccaaccataaaaaaaaa

SEQ ID NO: 969 - DNA, 115 bp, Homo sapiens
  misc_feature: Incyte ID No: 147379.1
aaaaaagaatagaatcacttttctaggttttctggcttgctttcggggacaaggtgttgcagtttccatgctctgccttgggaaggaggagttctggttactatgacttgcttca

SEQ ID NO: 970 - DNA, 1028 bp, Homo sapiens
  misc_feature: Incyte ID No: 147403.1
caaatgaaatcagtatcttttttctctacttttcagcaaagcaagatgctaccttataattaccacgtaacaatcaatcgcaaacatagtggcttaaagcagctcctcttttagcctacatatctgcaaactggcagtctggactgagctcagctggatgttttttctgagctgatcatgtatgtagggtctgctgctggctggtttagactgatggtggatgagaaaccacatgaagaagagaggcatgatggtggcagagttctgaaagagtcacacagaagggcgttgagttcgtggcttgaaaatagcatcctgtcacttctaccacattgtatttaccaggccagcccagataaagatgtgaagaaacagactccatctcttgatgggagaagttgaaaatcaatggaaaatggcatggataaggaaaggagtgatgattgtggccatatttgtaatggccatatttgatacccttttcagttttcctagccacacttctcattggccaggaaaattaaatgcatgtcaacactgaagaaaacagatcttggttaaaagcaatgatgtagctaatatcccgttcaggtaaaagattacttatatagtgtgagacaggcatgaggcagagaagtgcttacaggttggtttctgctttgttagcagatttacttttagatcatatactactttgtttttactgttttattgagaaaaaataacaaatatttccaaaattttgcagcatgcaactcagtgcttcagttggcattcaatcaaaatttccttgaaataaaaaaagacaagagagagacttggaattatgactcttctactagattagctccttcatgtcaaaatctgtcaagtttatgatttattcagatagcacttgtttttggtgtaataactaaactgttgctttagagtctactacattctcctctattatttggcatttttctctttattattttgttcaagtaggatattgtgctgagttgaaccatgaaatgaattgtatt

SEQ ID NO: 971 - DNA, 569 bp, Homo sapiens
  misc_feature: Incyte ID No: 1041063.1
cggattatccggagccaaggtccgctcgggtgagtgccctccgctttttgtggccaaacccagccacgcagtcccctccctgcggcgtcctccacacccggggtctgctggtctccgcggatgtcacaggctcggcaaccgccctcctgtcggcggggagtcccgcgacgcccggaaatgctccgaagcctgtcgctcagctgcccgatctgcgtctgtgtccggttccgtcactgaggtcgcccctgtccggcccttcctccctagttctcttcaccgtccgcccatcctgtcgcgcgccgcgtcaggtccccattcggcatgtggcttgtcttccatcgtccccaccctcgcccctcttggcccctcagggcagccctgggattcggcagacgccagtcctccctgagatgcttccccgtccttccctccgccaggccctacgtctccgcaaaccccacgcttcggggtggccgcctcagacaggaccctgagtccgagactggggtaggggacctgcccgatcctgtaacaaccctcgtgcttctgcacaatcgcctcccactagc

SEQ ID NO: 972 - DNA, 532 bp, Homo sapiens
  misc_feature: Incyte ID No: 1041063.5
acaaacaccgacagtgaaggagagtgacctgagcaagcagtagtggggtaaatggaaatagacaaaatgggaatcagcagagatatggaggacagaatacaatgaggaggccttgaccgtcagtagcagagagggcagcagaagcctaattcccaaattccttagatggttttctgatttccaaattagtttcccttttaaatttattgtgtcaggttcagcttatgaggcctcaatacttttcagtcttaattgtatattgaaaatactttttgtttactaaatgctttttacattaattcagtgtgcacttcgtaaggataatgatgatttgagttagtttagtattcaacagcttcctctattcctttatatgatctctgtatttaatagctgtggcataaagtttccaactaagtataagtatcaagttttctttgtgatgttttctgcaaatattgaaggatgacctggattgtcctagaactttgttccaacagattacatgtgttcataacgaataaattgctca

SEQ ID NO: 973 - DNA, 518 bp, Homo sapiens
  misc_feature: Incyte ID No: 230912.1
  unsure 112, 476: a, t, c, g, or other
gcatcctcgccgctctccctctctcctcgcccgctgggtgctgaagttgggcggatggcagcaaaccggctccgctagaggaccgagccgcccagccccgctcccccggacncatcggcgcgctgcccacacctccaggcgaccggccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctgcctcactgtgaggaatgaagaaagaggggaaaatgcgggaagacccacacacatacaaaaatggagagtatccaggtcctagaggaatgccaaaaccccactgcagaggaagtcttgtcctggtctcaaaattttgacaagatgatgaaggcccagcaggaagaaacttttcagagagttctccgnacagaatacagtgaagagaactattttctggttgttgtgaag

SEQ ID NO: 974 - DNA, 6316 bp, Homo sapiens
  misc_feature: Incyte ID No: 1089708.18
caagggattacaggcgtgagccatggtgcctggccctttaattcccccaatatttttttatctgcattaatttattatttcaagtgaacttccatctcaaatacatggttctcagacgcttccatgaactctcaagtgtgacttattacagcctggggctccttggagcacagtgtgccagtgacctagtggaaggccatgagaaagccaggttcactgttcactgtgcagcatctccctccacgggctccaggactcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccgggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggttcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtctcaaaaaaaaaaaagggaaatcctggctttctttaagccacagacttcctaggctgtggtcccagctccttgtctgcctggtccctgtcaccttgcagtgccaccacccccaggggctctgcttgctcccagtggcttctgtagcttgggcaactggcagatctttatggcagtagaggtgccagcatggaggatggagttggggtttataacccaaccctcaaacgaaccagcctgtgggggcctggagtggagctggtttgggggagtcacaggtgcggggggtccatcttctcctttctccttctcctttcctgacccctccgacagtttccatgttggccatgggtcaggtgaatggatggagctccaagcggggctcagcccattgacccgagcgaggcgcacacacctgcagcgtggatcaagcgcaactctct

SEQ ID NO: 975 - DNA, 483 bp, Homo sapiens
  misc_feature: Incyte ID No: 1050390.1
  unsure 6, 367, 478: a, t, c, g, or other
gcgtangtcctggtagacatgctgcagccccgccgtccccggcttctccgtgaggtccccgggactcctcgccaccacctggcactggcccccggctgcctgctcctggagtcgcgcggggccccctctccgtccctgcccaacccgcggaggcttacctcactctctcttcgggttgcattcgccataagagagccggtagacccctgaaatcccgggaccgcctcccacgcaaaacgtgagacaaacaaaaggaaaggcggaaacgcagaaacgcagaggtagccagtggatgaggcatgcgcagagcccacgctcaaagcctggcgctgttggcgcccaacctggaaactacctttcccgtgangacgcgagagcagcccttcgggattggcagagaggtgccccgctaggcagtggacagatgcggtctgagttggtgtgggaactgccgcagccctggctctcccggggcganccaaa

SEQ ID NO: 976 - DNA, 2309 bp, Homo sapiens
  misc_feature: Incyte ID No: 088957CB1
acacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaaaaaaaaaagagaaaaaaggggaaagaaaaattatgc

SEQ ID NO: 977 - protein, 609 aa, Homo sapiens [sequence omitted]

SEQ ID NO: 978 - DNA, 3679 bp, Homo sapiens
  misc_feature: Incyte ID No: 220943.21
gccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaatagc

SEQ ID NO: 979 - DNA, 842 bp, Homo sapiens
  misc_feature: Incyte ID No: 028005.14
acaggcaccttaggaagcagattagcaacatggtacagatgagaaaacagaggctgacacatgaggaaagaaagttgcccctaaatctttaataggtagctgagttgatgcaaacctagagtttttgtgactctgaagtcccttgtgccacaccatctggtggacacatgacatgagacatagaagcactttataaaaccatcaccagtgtgtcccaggtcaggctgccttggctcccacttcctgaaagctgagggtggcccccgacactttgaaatgcaataaggcagacttaagagaaatcaaaggaagccctgttcatccagcaagtcatattctctccacccccattacgtccagagaaaattcagtgggtttcagaaacagccttgaaggtgtttatgaattacagccacctgtatccgtaagggttgcaatctgctgtgatgcatttgaattaagaagcatttgaatgaagccagctctaaggccatcatgatgttcattatctacataaaaactgggtccactttctgtcgttaatggctttgttttgtattttccaggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtg

SEQ ID NO: 980 - DNA, 1620 bp, Homo sapiens
  misc_feature: Incyte ID No: 980446.1
  unsure 1524: a, t, c, g, or other
caagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttccccttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcagtgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacngaacttgccctagagatgaaattaaactaattgaaaacatctgctggactctgatggatcgcctaggatatccaaagtttatggactaaatgctgc

SEQ ID NO: 981 - DNA, 1186 bp, Homo sapiens
  misc_feature: Incyte ID No: 198827.1
gcaagcgaaaggagaggaggcggctaattaaatattgagcagaaagtcgcgtggggagagtcacgtgggtctggaggctcaaggaggctgggataaataccgcaaggcactgagcaggcgaaagagcgcgctcggacctccttcccggcggcagctaccgagagtgcggagcgaccagcgtggcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaa

SEQ ID NO: 982 - DNA, 534 bp, Homo sapiens
  misc_feature: Incyte ID No: 215112.1
aaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagta

SEQ ID NO: 983 - DNA, 2730 bp, Homo sapiens
  misc_feature: Incyte ID No: 977929.1
  unsure 2714: a, t, c, g, or other
cacacatggagatatagaattgaaattgctctgctttctttacaaatgactcagagtgtgcttgtccttccctaaaatgttgccagcatgtaaaggattttcaatgagcagtgcaataagccagcaactgggaaggcttggagcggcactgatataacgtggtgctgtcacacagataatcagggctggagccaagtctcggtagcgctgtgcattatcctggtcacatactggaagttttgtttatccaacttggttgctcttgaagctggtgagagccctgccaggatgtggagtggacttcctagcagaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatgcagtaaggggtcaggactacaagacaagacatttcattgtgaaatctgtgatgttcatggtaattcagaaattcaactcgaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtacccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtancttttcaataaaagta

SEQ ID NO: 984 - DNA, 609 bp, Homo sapiens
  misc_feature: Incyte ID No: 281447.2
ttaagcacttcactcattacctcagttaatcttcaaaggaagcttgtcatttaggtacttgtcatttgcatggctcagagagtttgagatcttgtccaggttcactcagacagggtgaggcagaagcacgggtttgaacccaggcattcaagatgtagagtccaaggttttagccactatgtctagcttcctctcttgtgaagtggtaggctttcttcagattttcattcagaaagtggcttgtgtggtagacggtaggttctccctgggaaccgggattttgattttctctgcagttactctacccctgtgatttcttggctgggtaggtgctcatctgacatgaagtgcaggtgtgataattaaatttcttgcctctggcagattgctaagtattagacagtggcaaaaaactgtgggtatcttatatcttcggtctccagtaataagttctttgcccctaccaagaacttattactggagaccgaagacataagttcttggtaggggcaaagaacaagaagccatccttgctcttcagaatgctttctatcctcagcaatttaatcattatctagcggaaggttggttttcctatttgcaatgaga

SEQ ID NO: 985 - DNA, 1789 bp, Homo sapiens
  misc_feature: Incyte ID No: 346641.3
  unsure 513-514, 555: a, t, c, g, or other
ctgagttcggcagctcacacagcacccctttcaagttgttttgcagtgggtgcctcttgtgagacactgtttctgagagcagcttttgtggcatcttacagggcagatttctggtcccacccacctctgcctccgccatggctgcaagaaccgttatcattgaccacgggtctggctttttgaaggctggcacggccggctggaatgagcctcagatggtcttccgaacatcgtgaactacctaccgtgcaaggagaaccctggccccagctatgcccgtagcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcgaccgaaagaagatgctggagatcctgtttgagttgctgcatgtcccatcgnnctcctggccgaccagctgcagatgtccctgtatgcctctgnctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggtaagtactatagtatgtcatccttggaaaccctgtctaggggactagtttttccagggtggcctatcattggggtatgtagtggctgactgcctatctccatgcctgtagtagcctactgatttttctattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagc

SEQ ID NO: 986 - DNA, 2343 bp, Homo sapiens
  misc_feature: Incyte ID No: 230793.3
  unsure 39: a, t, c, g, or other
gcgcagtcgcccccccaggcagcctaggcggcggcagcngctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagagaaagcgtttgatttatgagcgtaggacgaatcgcatccaggagctgcgcagccctggccgctgccgggacgccctgctccgcgctgagcttggggccagaaaccagccatagtccccacactccgccgccgcagctgagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaagaagaaaaaacacttattagaagccctagtcattttttggctttctgttttgttgctgtccattgaagactttgaacatgccgccttaataaatgtaattaaaattgaacataaagaagataaattgtgacgaattttatttacgaagttagactaaaagaagaaaaagaacccgttatgagccttgaaaaaagagggggagaaaaataagctacttatagcaaaggagaatttattctacaaaaaatatgcatgacaatgcatcccaatgtaatacaaaaataaaaagaaagtgaagatacaattatatgatcactttcttgcaggcctcatactgctctcaggaatcacataaagggttgttgagttaggtttaaaacaactaaaactccaaaataatctgtaaaagatggctctgtttgaaactgggtcagggaatcactaaacagaaatcctcaacacttaaaggagggaaggggtaggtcaagaagaaaataaaaaataaactcccaaataaaagaaggcaaaaccacctggtcaaaggagtttttgtttggtgatgctttgttttgctttaatgtttttagtaattcagatgctgcaagtcgattgtggtgagtgtgtctgtaaaaaagtctaagctgtcagctgaaatatctacgggactgtcgagggaacctggcaaactgggtgaaactgcatctgaaagctgcaggcaggaatctgtggagaaaacgctaaagtcctgcaaagaggggacctcaagggcctcaggactgtcattgtttaggccagctccacagttctggcccattgttgacaagcagttgggaacagtgggtgactggtgctgaaaatgtttcagatttttctcattgctggttaaaggcgagactgggaaactttgggagtcgccattgtgtccattgggagcctgctgctgagagagggcattttgctgaaaagtgtagccttccctctccagaagggccccagagacgctaagggcttgctcaaagagcgtcttctcttcctcgtcctcctctactttctcggagtcctcaaggcttttacatttcccttcgctgttttggttttccttgcactgggtctgcctcttgtgcttcatcctccggttctgaaaccacactttcacttgtctctcagtcaaatccagcagcgctgcaatctccacccttcggggtctgcaaaggtacttgttgaaatgaaattctttttccagctctagaagctgtgtgttggtgtaagcagttctcaggcgccgcgatcccccgccgctgccatcggcgatttccagggattctttgtggctgaggcaagcagggccggtggctgcggcggtggcggcggcggcggcggccggcagaagtgcggttttcttgccgccttcttctccttcatccaggggtactcggccgcctgcagggcgccggcgggcaccgggctgccg

SEQ ID NO: 987 - DNA, 879 bp, Homo sapiens
  misc_feature: Incyte ID No: 431288.1
tgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaatcggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatatgttcaggaattagaccacgtaacaattataattgtcgaagactttgaaactgcatagtagattgtgacattggagctttttgttgtgctcattagaaagcagggtctggaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggag

SEQ ID NO: 988 - DNA, 4797 bp, Homo sapiens
  misc_feature: Incyte ID No: 4215034CB1
aggcggcgcctgtaggctggagggactgtgagtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaggagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggcgattagggttgctcactgtagcaggtttaggctacagaagaggggcacttttcatacgagtcaacttcaggggtgatctccaggag

SEQ ID NO: 989 - protein, 1164 aa, Homo sapiens
  misc_feature: Incyte ID No: 4215034CD1
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 990 - DNA, 717 bp, Homo sapiens
  misc_feature: Incyte ID No: 150627.1
  unsure 437, 466, 471, 507, 698, 707, 710: a, t, c, g, or other
gacataatatacctatgatatactggcctaaaattagtgtacagaaattaattgcattgaataatgcatagacatgcattgttctttccctaattcctcacttccctctctttttcaagcattgtgcccacatctgcctttttgcccacacctgaagatgagaaactgataagactgcagttgcccatagatagatgataagccctccgggagggaccagtaattgttgcagggttttcagagctgtaagaactagttcttaacacttatttttctctccagagcttataacattgggaaccagttccaaagagctggatcaaggataagaaacaaaatctatatatgcatacctttttcttgcatttggtaggaagctgtgttctcacgtctgcaatcagatgcaagtaaaccagactgagattacttgcaagctnttattgacttctatatacaacaccacaantaaanctttttctcatagattagagagagtgcaaaaggaancaggtgatttgtgaggtaacctgccgttatgttaggcagtaatagaaaacattttaaaatatttgaaataatataattgctttgcactgggaacacgtacatgaataaaagatgttagcaggtgtcctaactagtatggaatctcatgctgttgtatttattggaaatatgcacaccatcagcagatgtanatttgtaanaantaatcga

SEQ ID NO: 991 - DNA, 1183 bp, Homo sapiens
  misc_feature: Incyte ID No: 121731.1
  unsure 684, 708, 722, 728-730, 789, 862-863, 865, 886, 890, 894, 905, 938, 942,950, 968, 1076-1077, 1083, 1094, 1104, 1107-1108, 1111, 1142, 1144, 1161,1169, 1176: a, t, c, g, or other
cccaattctgttttctcatggcaaaaagcacactggtttagggttgttcttgtttttctttaaatcatattttatacaacatacccctctaagcaaatgacaacatagcactaggtcatagtgaggttaggatcacattaggacacatttttttgtgactgtcccacccactttcctataggttactagctactcaaaaactggacaagagaagttaagtaaatgagaaaagctctctattttatcaattatggttgaaggtggaagtagggcccaggattccctggcgttatccctaatcccaaaacccctcaactttctagtgactctgaagcacaccctgggtagacatgctcagagtgacccagagctccaagctaacccaaggctgcctgaaatcaaatagaaggagacctctatggacccatattccaagattcagacaatctatgaagtggttaagagggtgagctctaggctgggcatggtagctcatgcctataaccctcccacagtgctggtattacaggcatgagccaccatgcccaggccatcattttatgtagatagcgtaacattaataccaaaatctgacaaaggaagtaggacgaattaaattgtcgaccaatctatatggatttgtcattatggatatcaagaacacaatcataaacaaagtattancaaatggaattcagcaatgtatcnagaagacagtgcantctgtnnnagatcctggtcccagaatgcaaggctggtttggctttagaagcattagatcagtataanaagcttgaccttacagattgaatgaaaaatgatgtaattatctcaataaatgcagattaaaagtatttgatannanctagaagatatatttgagaanatgntagnatcaactcatntcataggattcttaacaaactttatagaagtgntctnccttaatntgataaatggtactaganaagcaccactaggatcccactcagagcaaaccttgaaaggtttggttcagagaaggagacagggcagtgtcaccacttgtatccaacattgtacataagggtaaggannaaaatnacgcaaaaggnatggcacttngannaantaaaagtgaaatttactgatgatatggccancnacttggaaaatccaatngagaactnagtagantaaagta

SEQ ID NO: 992 - DNA, 132 bp, Homo sapiens
  misc_feature: Incyte ID No: 259907.1
gctcgagaaaattaattactcgtcatcattttctatgtgtttatatataagtatttctgatgctaaatgctttacgcatattgcctagtttaatcttaaaaaccaaaaaggaaactaaggatctgagacatt

SEQ ID NO: 993 - DNA, 610 bp, Homo sapiens
  misc_feature: Incyte ID No: 977727.13
  unsure 559: a, t, c, g, or other
ggctcttatctgtcttgtgtctgttctgaacccactctggtgtggcagtgtctcagtcccaatctgtgtgatacgtaggacggcacacagcctctcggcaagcaggctcattcctgcacgaagcttgcaaggcagctctctctaactggcaaagacctttcttggtcatggttttcctccttgcaatctggcctcactttagggagatattctcatcagggaggctgagaccaactccctctcctgggggtggcgcctccctgacaccagctgtggtgtgcagatgtgcagtaaatgtcgcatcgttatcacttcaaagataatttcattcctggaagactggaaatccttaccctgggttttggcaaacacttacattagagttgctcagtcagttgcagctttaaaccatggcgccccctgcccacccagccagctgataatttatgagaaacaggtgtacaaagaatgagtacattgggctgcggacccagatcaaacttcagaaaatgcagattaccaagggttaatcatttttgagcaagtcttatttccactnggactgcatctgcacagcaaagcaagccactgaggcaaaaagaaaaaaaaa

SEQ ID NO: 994 - DNA, 649 bp, Homo sapiens
  misc_feature: Incyte ID No: 005915.1
tgcctgctttggatccagttctgtaagggcagaggattcattatttccaggtaatttaagtatgttctggggagaagtgttacaagatggactggggactcggctgggatcctgatgggatctaaattattgatttcacctgactgaattgctatttgcgtcacacctcaggaccctggaaacaatacacaatttgcccattcattaatttattaattcactcaacaaacttgtacatctgccataagtctgacaccatcctagttatcagggatgtagatagtcaaaagaagatgtaaacctaacctcatgcatctgtgaatctccccatctaaaaagacacagccttgtaaagaagcttgtgtgaaagtgctaacgacagacatgccaagtgttaaggggatgcaggagaggcgtggtaaaatgggttgggaggcagctcagatgtctaaaggggtcaggcagacaatgcagataagtgaaagagggccagttgatgcagagtggggacatctggaaagcacccgccccatctaaaggaggcagcctctgagagtctggggatcagggatagaagggagatgtacttttcactgtacatccttttgtattttttaaattttgttacttaattcaaaaaaatgtaaaa

SEQ ID NO: 995 - DNA, 490 bp, Homo sapiens
  misc_feature: Incyte ID No: 008835.1
gtcctagtggtagagaaagaagatgggagaaggactttttgcaggaaaattctcttactgtaatgtttcttactccaacacaaaacacatacacacacatatatacatgcacacccacacagataaaacagacaaatcagtgcattgctttgtgggcctcacatcagcctctgaggagacttgcatctctcagtggtgggggacacattcagggtttctagacgtgtcccaaaccactcactttccctgaattttcagcatttaggagaaatttccatggagaagaagaatcgctgtctggtcatccatgcaatttcctgctcagttttaatagcagctgggcttctccctgtctaaggttgaaaccaaaaggctgtattttcctgtgggggcgagagagagagagagagagagcgagagagagcaagagtgagagagcgcttacaaacgcctccctggacatttagaatttctaaatagaattttggct

SEQ ID NO: 996 - DNA, 1941 bp, Homo sapiens
  misc_feature: Incyte ID No: 242010.60
cgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctggccaccaaggatgcgggtgtgatcgcggggctcaacgtgctgcggatcatcaacgagcccacggccgccgccatcgcctacggccctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgcctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgtttttttttttttttttgcttggcgaaaacactacaaaggctgggaatgtatgtttttataatttgtttatttaaatatgaaaaataaaatgttaaactttttcttgtctgttaatatgtgaagataatggatatttgcggagggatagtgtctgaataccaactgatctcttatcagtcgtgaaaagtacagtactgactgaagagttatacgtgtaggacttagagctacacatatttttattgggcttaacttgtgggccttaagagaaattgcaggtgcccgtcttgattagagtggggcttgtttcagggtaa

SEQ ID NO: 997 - DNA, 770 bp, Homo sapiens
  misc_feature: Incyte ID No: 242684.1
  unsure 540-700: a, t, c, g, or other
gtttatcattaaagatcagtggcttttgtgagtctaaaaaattaagccttaaatgttttcatcaaattccagttaactacctgatttatctaggttatattaacagtattatttagaatttcaccttgatatgaagatgtctgtgtaacttttacaatgatgtaaaacaaagagtaggattagggagggcacaggccactggtgcaatggataacgcgtctgactactgatgagggaatttagcctggaataaggaacttttatttccagcttagtgacgcacacaaattttaaaaataaaataaaaatcatgttttatgtgattcatgtttctcctaatgcaaagaagacgggtactattactaaaaatatttttaaaatgtaagggctaaggccccagaagttctgctatgattttttatgtttcatagagtgattatcatcacagaagctcaagcattacataaatacaaatgcgtgtaccccgacctggtaattctgcttcttgaaatttatcttcaggtccacccgcacatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagcaagaaaaagagaaagctttctacattcaaactaatagtagaaaactctccaagatacaatttt

SEQ ID NO: 998 - DNA, 2042 bp, Homo sapiens
  misc_feature: Incyte ID No: 335145.1
  unsure 824, 870, 872, 1067, 1086: a, t, c, g, or other
gagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggnttcagaatcgtaactaagaggtaaggcattggagaaggacaatgtnanagacagaggtttacaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattganatcattctgcctgtttganagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttc

SEQ ID NO: 999 - DNA, 1792 bp, Homo sapiens
  misc_feature: Incyte ID No: 678004CB1
tgcgggagaattctgcggacctgcgggacgcggcggtggcgcgtagagccgggacagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcacggctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacctacggcctctgggctcctgtgccctctagtcccgtttcctcagcagctctcttcctgtcatttgtgtctcctccttctcagtc

SEQ ID NO: 1000 - protein, 441 aa, Homo sapiens
  misc_feature: Incyte ID No: 678004CD1
MEQPQEEAPEVREEEEKEEVAEAEGAPELNGGPQHALPSSSYTDLSRSSSPPSRLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 1001 - DNA, 257 bp, Homo sapiens
  misc_feature: Incyte ID No: 092922.1
  unsure 131-199, 207, 212, 223, 238, 246: a, t, c, g, or other
aaataaaaataaaaaaacaaaccaaagtgtccttagatttaacaccaaaggcataatccacaaaaggagaattgctagattcaacttcatcaacattaaaacttttgctttgtgaaagcccaactacaagnnnnnnnnnnnnnnnnnnnnnnnnnnnnnnnnnnnnnnnnnnnnnnnnnnnnnnnnnnnnnnnnnnnnnttccaatntatanagaactctganaagtcacgagtccanaacccaancagtccactta

SEQ ID NO: 1002 - DNA, 2278 bp, Homo sapiens
  misc_feature: Incyte ID No: 411373.7
cctctccccttctccgctcgtcattggagatgaacacatcgcgtttgcttcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcg

SEQ ID NO: 1003 - DNA, 898 bp, Homo sapiens
  misc_feature: Incyte ID No: 404715.1
ctcaactctggttagctatgactgaaacattcatgccattgcagccagtgccctggaaagctataagcaagtcttaagacctgtgataagggctgacttgcaagctagctgccgtccatcttaatatctgacgagcccagtcatgttggctgtgtttaattgatccatttcctacttgcttcctcaacccagaggccaagggcagcacaaaaggatagtgaatctaaatgtctccagttttttgaggtataggaatctcctatgaagtggcagacctttgagaaatagtattatgagctgttctgttttgctgtggctttggaaaacctttggattcctctactgaaaatttgtttgaaaaaaaaatctttttaatgaaacagtgtgagtcataaagcagccaccaccccttctcataatagcatttctcaccagggaatttttggtagctgttgggggagggatttgagtaggttgtggatgataaatcccttgaggggaacataaccaaaggctgccatatcagaacgctggtgctttccatgctgacaccaagccctgaattcaaagtgcaggacagcagaatagaacagagaagcctgtgctcagtgaattgctgcagtagcatgaccagtgagactggagtttcaattaaaacaccgttgtagtgtaaaaggatcatgagatggaaggaggccttgggttagagagccagaagccatttataggcagaacatcagctttctggattaaaggatggctgtggacctaatgatgagaatctagaggtcatggggaatttccttactgtctgtgccccccttttccatatggtcagcttggtgcttggcactgatcatggcacactttacaaaaagtggattcatataaggtcgtc

SEQ ID NO: 1004 - DNA, 456 bp, Homo sapiens
  misc_feature: Incyte ID No: 278831.1
tgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccat

SEQ ID NO: 1005 - DNA, 3957 bp, Homo sapiens
  misc_feature: Incyte ID No: 343924.8
tttttttgaagggaaatagaagccacttataaccaaaccaaaaagagaataacaatgctaatatcactacagaaatatgattcctaaaaattaataacattatatacatactttagggcagttctttttgttcttaaggtacatcatcctaggaatgtttaattatatgacaactttttaaagtcatttgaaatagttcctgaaaaatttcacatgactatgaaatagaattggaaaagaaaatatttaaaagtagaaataaaaagtaaacaaaagatgtacttacatgaatgagttgatggcatagttacataagtttgctcttaatgtatggctctaagtctccaaatgtgtaacttagctaaactcaaaaaacattaaaagtttttttctcatatatttataggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccccgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttactggtcaacccaaccagtactgttgccaagcaacaagtgttacacgagaatctgaatgcatcaaatcttccttggctgtgatttcttcgcgaccccagttttctctgtttctgagtggggtttgtttttttcctggattgtacacacagggtcaggtggaatggagttccaaatcactctgtgctccgcggcatcccgatttctttccgcagctaacctcccgacacgtctgctgctgttctgtggcagaaagacaatctccgtgttcaggcggtgagcttgctttccttcacccttgaccctggggttgcaggccatggtgttgggcgtatccctgagtgcagtgtcctgcgggattcattcctagtgcaccgagatttcctaggtttcctcagagtaagcccccagttgcatcaccaccgactgtggtgtggctttggatgcctgaagctgagttgattct

SEQ ID NO: 1006 - DNA, 2291 bp, Homo sapiens
  misc_feature: Incyte ID No: 200977.1
tccaaatagatccactttcttgttaattacttttcgttactgttgcggttttctgagaactagcctaattgtttctgtttctctttatcatcatcaaacattgcagctacgactacctgtcatttatcccgctctcggatatcatgcgatatttgtctgtgtcttctttttaaaaacactgtcgtcatatttgtggtctaatacttgttttcttcccccctaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaatttgaggtcaatggaacatttaa

SEQ ID NO: 1007 - DNA, 2485 bp, Homo sapiens
  misc_feature: Incyte ID No: 181818.3
  unsure 2305, 2307, 2314, 2425, 2428, 2433-2434, 2442, 2477: a, t, c, g, or other
cggccgcccgctctccccggcgcccgccgccgccgctcgcttttttaatgtccacagacagtgaaaaggaactcggcgttagggggctgccaccgtgtcggaggcgaggcgaggaagggagctggaataacaaagggaggtaatggggtagattggatacctctggggtcttggaagaagctatgacttatttactgtctactatgtgattgttcattgcataaaaatacaattggtgagccaggtgccgtggctcatacctgtgatcccagcgctttgggaggctgaggtgggtggatcaattgagctcagcagttcgagaccagcctgggaaacatggcgaagccccatctctgcagaaaatacaagagttggccaggccctgacattctccagctttcatggtgttcctgcaatccaagtgccgcttatctctctacaggtgaggttaggggttgggaggatgtcctgagcagggagcaccaacttctctggctgcaggaggggagggagggggtggccggctgccctgggtgccctttctttcccttccatccagggctggaagaaagccatacttctgactccaggaagtgctttggtggagctggaccggcttctgagctgtctgtggcgtccaccagatgaccggctggcctcctaattgggcttcctgcattcctgcctgtgctcggagctcccttctccacttgcctgctggaggaggtttacaaacaaaatcagatcatggaactcacctggggccctgcatcctgtggacagcaggtcttggaaacgcccctgtaccccagaaacttcctgatcagtccctggtcagtgtatatcatgcttcctgtgacatgacatcaaattttcagtgacttccactggttttggcccagctcgaacactgacacctctgcagggaattctaccagggagaagagaaagtagtcactgcttccagtttttttaaggagttggccaagagcagcaccaggcatcagaggaaggcagctgactgcactcggccacatcccaaaagtgcctggaagggggagggaggaagcaggcgcttcagaaggcactactgtgtgtcaggactcatgctaggaacgctgtaacagggagcagtgatggagtccttgagggagctcaggagggggaattgcactgaagatttgtcccaatcgtgaagcaagagcactggaacttacactccaccatcaggccctgtcacaggagaacaaagaaggaaggcagaggagatcatgctccggccagcagggaatctccatttttttcagcctcataccttggaaagtacaaaggagtgagagctgggacttaccagccagagggttcatggaggtagtgggaggggaagatgggttctgcatgggagccactccagaggacttttcttctgtctcacagcctgacaatcacctctagctgttctcagtcccattctcatcaatgacctcgtctcctgatttttgtacaatatctaggtgaccttctcttctttccatcttcaaacgcttgatcattgatgctcccttttctcttctctctcctcctgggaaaagagaaggaccaacatccccctttcccttcctcctgtgctgtcccgacccctctgagacctggctctatgcagtaagtccctctctcttctgcagcaccagcctctgcccatccctgccctctgcacacgaagctgctcacaccttgtcgtgcactttaagaaactataatgtggcaaagccctggcaaatcctgccacattgtttaccactcttctaaaaaggctttgaggtcatcaattgacctatacccatttgaccctgtcctgtatctgactgttgtaccctttctctttgatcccactcgtggccaactctcccactacccctttcttggatcaactgtcttgctcctcagtcttgatcaatgcctccttctctctctttagccttggccctttttggccagggaaataaatgtgaaatacataaagcttcattttatcttatgattatagctatgttgatgttacccaagacctaaaagtcacactctctaattacacttccctcctgtgttctgggtcctcttggaccagtccttactctggctcccctcctggatgtctcccagacttctaattagaattactgtttcctatatcaagctaattatctttcccaccaacctcctccgtccttgggtgaaagcatcacttggttgcaaaagtcagaaatctgggtttcattcttgcggtaggtagaataatgccccnangccccangttttgacatccgaatccctgggactttgcagatgtgattcagtttaggattttgagatggggagattatctgggagagcctgatgtcatcataaggttcttataagaggnagncaggnnggttagantgagtagtaagagatgcaaacagtggaagcaagangttggggt

SEQ ID NO: 1008 - DNA, 1237 bp, Homo sapiens
  misc_feature: Incyte ID No: 029251CB1
atcctgggaagcagagtgtctggatggaacctgagctgggtctctgactcacttctgactttagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatatttaaaaaaaaaaa

SEQ ID NO: 1009 - protein, 312 aa, Homo sapiens
  misc_feature: Incyte ID No: 029251CD1
MAKVFSFILVTTALIMGREISALEDCAQEQMRLRAQVRLLETRVKQQQVKIKQLLQENEVQFLDKGDENTVVDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 1010 - DNA, 2712 bp, Homo sapiens
  misc_feature: Incyte ID No: 335648.1
attgcccctgtaacctgtcaaagaagagctaagggagctttcggggttggcttcttggaggctgctttctcctttacttggaaggcttcgctagtgatggacccatacatgattcagatgagcagcaaaggcaacctctcctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcaaaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgaaaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaa

SEQ ID NO: 1011 - DNA, 13930 bp, Homo sapiens
  misc_feature: Incyte ID No: 331108.1
gcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcatcctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataaaa

SEQ ID NO: 1012 - DNA, 3074 bp, Homo sapiens
  misc_feature: Incyte ID No: 333840.1
  unsure 2358-2447, 2522-2843: a, t, c, g, or other
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgttcaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcgtcattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccacagcgtcccgcgtagctggcatacaggtgcaagccactatgtccagctagccaactcctccttgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattact

SEQ ID NO: 1013 - DNA, 1040 bp, Homo sapiens
  misc_feature: Incyte ID No: 334298.1
ctttttctcactttttcctaatgagttttgttatttttctttaatgaattttaggaatgctttatgtattgttgctattaatcttcaattttacgtatatttgcatagtaattgcctacttttagctcttcgttgtcatacagacatttttacatttttatttacttaaatttatcaatctttttctttagagtttctctggattttgtgttttattgaggagggttatccccatcccaagaatatatatatgttttatagtaattctttataatacttctataactttgttttcaacctatctgaagtaataattttcatttgatatgagttggaaatctgttttaattaggactttttcaattgcaagtgaccaaaccaacttaaactagcttaagtgaagagggaatttaattagctcatgtagttgggaagtccgagccatcatcaggtataactggaccctcaggtatcaaactctttgttttcctctctctctcaccttttaggtctacatatatttatgtgtgttaacctcattctctcccagtacagacaggctattcccatgtggcagggaagatggcaccagcaatttgtatttatatgtttccaaggtctgtgacccaaaggcaaggcccctacttctgctccaaatcagaagcccttgaggaaggaatttgagtggcttatcttggatcatattgtttctaaccctatggccagggcaggcaaggtactacgattgatgcctccagcaaaagttgggtaggaatggttttctaaggaaacagggacgctgcaaatattatagcatagtaaatatctacacttccatcctttggtagctcagcacgtgtgtgtactcacatttgttctcatacatacaattcaaaaatggttctgcctaatataatgcaaagatttcacccacaacttaaaactttttcaaaaacctctttcccacagttacatcctgtaattgtatctagacctaaatctagtatttctctgtgtgtatattaatttcagtagatctg

SEQ ID NO: 1014 - DNA, 259 bp, Homo sapiens
  misc_feature: Incyte ID No: 344597.2
gctctctcccattgcccacccacccctttctggatcagctccttgtggaggggcagtgcacaatgccaccatcggccgcgtcctctccccaagttaccctgaaaacaccaatgggagccaattctgcatctggacgattgaagctccagagggccagaagctgcacctgcactttgagaggctgttgctgcatgacaaggacaggtaaagctctgaaggtccacacccaaccccgtttcttcccagaatattagaacat

SEQ ID NO: 1015 - DNA, 2613 bp, Homo sapiens
  misc_feature: Incyte ID No: 1262593.2
gccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccatcgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgcc

SEQ ID NO: 1016 - DNA, 4726 bp, Homo sapiens
  misc_feature: Incyte ID No: 461375.2
  unsure 4173: a, t, c, g, or other
gcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggcttggggtttggaaatgtanatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagta

SEQ ID NO: 1017 - DNA, 7186 bp, Homo sapiens
  misc_feature: Incyte ID No: 233660.2
ctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtcaaaatcttataaggccatatgtcctgaaaggcaaaactctgtgtatgtgcgatttaccagggagatagtaggacagtttttatgagggtttcaaaggagttcatggcccaaatgaagcttgtggccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttcattcaaagctccc

SEQ ID NO: 1018 - DNA, 3486 bp, Homo sapiens
  misc_feature: Incyte ID No: 230179.3
  unsure 2560-2561, 2568, 2674: a, t, c, g, or other
atggaagaacgggaagaggtgctggcggtcacagcagcccagggttcgtctgtgctcgtttatagatttgtgtgcccatccagtcctcactgggccctcccagttttagaaatgttgaacactagtgcttgtaagattcgaacaatgagtttaccagctctgagaaaaatgaactgctccagaaccttcaagaatgtttctctgtatcacgcccacatcacaccgaatccatttgtcgtcattgcagagttcatctttctggttttgagcaccatctcacacagttctttgtctttttccagtctgctgttgactgggttagctcagcccgaaaggcagggctatgttccccaggccaggggcattgtcctggacagtcaggaggcatacccctcgccaggtggaaccaccctgtgtatgcatgaccctgacaagcaggcgccaggacagtcaggaggccagctgtggagggtgcccctgtgcccacctggccagcaccacctgcccagctcagagaaggggctgtggctgccgcctgccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgaggggcgggcctctgtgcccaggagttcccctgtctgtggggtttgaggccaccgaggtgctgcagggtggggttgtgcctcccttcagagggggtccgggtgtcagaggagggcacagaccccagagcaggcccaggagaggaggatggggctgccttccaggttccactggactttgctgacggcaggtggctcatgagtcgccatctgccctgactcacagatatgttcccatcctggtagcccagggtccccgggataccgcctggccccgctgagtgccatggatgatgggggtccttcttcagctcagcctcgcctgggccggcctgtggctcccattttcctttcagcgggacaaaggggacttgttaccaggccattttctggatggcctgtgagatctctgcccctccaagaccctccaagtctgagcctgacccacagctgggacactgaattcagccctgggaaccatgggggcttctatcaggcgctagacccccagcccttcccctggcactaccttgggaaccagggtggggtgtggggcctgggctgcccgggagcactcagcccgcctggccctctcttgggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacaaaccactgtggagcctgaagctccttaagaagagtccacaacagctggnnggagggnggggtgggcctgggtccagaccaggctcgctgctctctgggcctcagtttccccacctgccagcgggctcggccctgtcctcctcacaggctggtgtggccgtcanggtgggtggggttattgttagtaggcgcactcgattcccaccacgatctgttccgcgtggttcccgccaaacctccctcggtcgccgtgttctccgcaagcctcctgcagggcccgccttgccaatgtgaggctggcaccaggctgcagcctccccaatcccagcccactttgctgtgtctctggcgggctgtcctccttggtgggagctgtcctgcacactgtaggaatgcttaaaggtatccctggcctccacccatccctagccagcagctcccagtcagacaacagccagaaatgtctccagactctgcccagcctccccaggtagccaccctcgagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattc

SEQ ID NO: 1019 - DNA, 1640 bp, Homo sapiens
  misc_feature: Incyte ID No: 230179.7
cgggatagctgtcttgagccccaagcctcttcctcccctgctgcccctctgcagccattcgggatgggaccccctctggggtgtcagcacgaaagggctaacgggagccccttccttggcctccccctgtaggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtggggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaaaaaaaaaaa

SEQ ID NO: 1020 - DNA, 557 bp, Homo sapiens
  misc_feature: Incyte ID No: 296245.1
gttcattgtatgcagggcaatgcagagtggaagattatgaaaataaaagtcagatttgcaatctctgagcacctgtcttaataattataagaatcaaactgtccttgtgccccaggatcatggagtgattcagaaggttttgtagtaaagtgccatcagcattctttattttgtggtcaaagagacatttaaatatgcctttctttcaccttgagaattatggcccattcttcaaacactcagcataccgttaagcagtttatggagtggaacatttttgattcactgagaggtggtttgtgaagaaatttttagccatgagtttccagttatattggaacccatttttaacaggcttccaacaggagaataaagtagagacttcctggtgagatttagcagacgggactgttctgctgtgcagaattatatcttccctctcattgcttgaggactccagggtactgggctccagtgaaaagcaaacaaagtgtttgtccagaagaaagaaatggaacgtgtcctaaacaagttttttgattgcagaaaaagaattc

SEQ ID NO: 1021 - DNA, 2922 bp, Homo sapiens
  misc_feature: Incyte ID No: 981208.1
  unsure 668, 1152, 2651: a, t, c, g, or other
ggaattcagttttgaaaaattacatataattgtattcataataagaatgtggttatttcataagcagttatgaaagaattattgttcttattcaaaagtgatccagataattgtgatattttctatggtgggctactggtattagcacgacttggatattatttgttgaaggaagtatgaatgaagttggatttgaccaatttcgtgtaaaccttaattgatttaaaactgggaaagaggggggtttcctggccattgctgatctaaggtgctcttatttgtttccaataaacagtaatctttatagaccttaatgcagatttaaaaaaatagttgtgattggctgagagaggcagggcatatatgtagggaaatgatttgccccaagcattccaatgaagtatgacttgtaacttttgtgtctgaaggtggtgtctttatttttgtggaaaatgggagaaaaatgaataattgtgtttatttggctgattggtaatacactagaccattctgttattattgaatgaatgtttgtgtatatctctgctgttgcacatatgagtataggtgaggttgtcattgtttgctctgggattcagggagggagtcactttgcataaacctttttttgcatttaatttcttgaatgttcttataaagaagacatnatgttggcattcttcatttttatcctgccaacagagtgcttatgagcatgtctgcattttgatcaaaatttaaacagaagagtgaaaatacatttgaaatgaaccctttcagaggaaccctggcaaagctgtatagactggacagagtgagaaaacttccacagccacctgtcacctttctcctcatcttccactgtgttcaatatgtatgttccaagccatagagataattgggattttctcccaggtagcttctttcttctcctgtcactggactaaaatctctgacatgtcaaaaatgccttaaattttaatgaactctccgaaaatgtagttgatattggagaatttattttatttctaattttagatattaaatatattttgtcagcacagtcccatctttgggaaggaggtgattttttcccttggaattccagtggtttgttcattttatttcaagcactgaagaagtatgacaganagaatattatggggaaaatatttagacaacctggctataaaatttcctttagttttatgcctggcctttgcaaagctcagtgaaatgttgaaaggaataaattaatcatgtttctgtgacttttgattgacacttgttccttttcccccctaagtggtagaagaagttatttgttctttttcaaaaggcacaattttgaagccttaactacttcattaagtcaactgttgcctataacatctcttagcactcgtcaaaacgtatttaaatcaattttccaatggatgagaacatgtcttctgtggataaattatattatgtcatttaacaacattgagcattttgatatgtgttcactgaattaaaaaacctgaatttcattattgttgacttttcccctctttagttactagtaatcacatcctttctaggattaaaaatatttcatagtatttttgtgtagatgtctgtccttattttcttcccaaagaaaaaaggttgtttaaattgattatgtggaagaattacttgggtccagtctttagcatctggggtctccaggtccccaggtgggtcatgattgactgcttcttcaagacccatcttgccaactctcacttgatgtctgtcaatagaactacttcctgtggcacatggttatttctaatgggaggctaatgtgtacataatttctctcttcctcatagaaataaatttctctgggggttgctgtgagaggatgacttcattagccatgtttaaagtgagtgtactgctcacgtttatctttgtacactaagagtatgtagagttgatcttcagagaaactaaacctccctcatatctatttatagtaatcatgaatatgattgcagttgacaggcccaactcctaaactgagtttgcccaaagaaaatgtccttagaggagtaaacttttagaaatctcaacacccgactcattcgttggaagctaaaatggaattcatcttcatactaactggctacagattattctcttgctggattttacttttattttaacatttttacatgagttccttttagaatcataaatgaaagaagtaaaactttaagatgggaatgaataattgaaaagagaattatatttactattataattgatattattcgctattatgattacacttgtctagatcagagcccagcaaacattttttttgtaaagggtcagatagtacatagttttggctttgcagggcatgtgggctctattgcatttactcaactctgccattgtagtatgaaagcaaccacatacaaaatgtaaatggatgggcgtggctgcattccaataaaactttatttatggacactgaaatttgagtttcagttaaatttcatgtgtcatgaaatctttgatgtctttctaactatttaaaaatgtaaaagccttcttagctctcaggtcttacaaaaacaggtgatgggctaggatttggcctaatggttatagtntgttgaccccgtggtttagatcactgtaatctaccacagactattcagaagaatctgttgcacacaggttcttttccctttagaagcttagcacctaaaaagttgtcaagtcttcagagtgttcaaaaagaaaataactcatcacgtgcacttgatgatttaatcacttacccaatacaaagccagatactctcctgagtgcaaggataaaattaagccagtgaatggttaaacagtaaatagcagattttttaaaagcctttctcatggg

SEQ ID NO: 1022 - DNA, 3083 bp, Homo sapiens
  misc_feature: Incyte ID No: 406580.1
aatttctatttttgtgtatgttttataatgtacataatattttagtacagtagtacatgtatataatttacaaataaataattatacaattaaggaagtgaactaaacatttttttactgatgggaggcacaacccatgctcaggaagcacatgtgatggagtcagctttacactgaaagggcacaagcctgggtcccagattattgtgatgtgaggcaggagacctgggcatggttctggaggctgctgggaggagaggatggtgctggtggtcggcagacctgctgctggtcaactcagaggaaggaggaggagaaagggtggggttccagctgagacctagagtcaagacctgccctcacacacaaaaaagatgaggagaggagcttgatgagaagagaaagacctgggaagacaacagcccttccagcttctccagcgaggtggtgtctagagcatgcacacaactggcctacaaaatgaggctccatggtggagaggaaaacaagggccagggagagggtctgatgcccggagatgcccaaggacgcaaggagatcaacgccacaaacggcatctccatctcctgggcccacaggctttctgcacccctctagctgcccatcaactgactggagcttggtccaagtggcccctggctggaattgtgctcactgaccccactggagacatctgcccaccctggggtctgcaaatccatgtcagctaagtatcaggcccagtggcatcctttgtggttttgctgccagtcacatggccctggccgaacacaggtgtcacccagtcgagaggggcatcaagtccaaggaggccgaggagtaccggttgaaggagcactatctcaccttcgagaaaagccgttatgtgacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatgtgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttcaaaaaaaaaaaaaagg

SEQ ID NO: 1023 - DNA, 2258 bp, Homo sapiens
  misc_feature: Incyte ID No: 200051.1
  unsure 569: a, t, c, g, or other
ggcgcaacaccttagtgcagcccaccgcccctgacggaccgggaagctccgtgctgcctaaccctggtgagggcccgagcacattgtttagctctagtgcttctgtggaccggaacccctccaagtgttcccttgttttgccaagccctagggtaaccaaggcctccgtggactcagattctgagggtcctaagggtgcagaaggccctatagaattcgaggtcctgagagactgtgagagccccaactccattagtattatgggcctcaatacttcccgggttgcaataccctgaagccccaagaccctatggaacagaacgtagctgagctgttgcagttcctgctggtgaaggatcagagcaagtaccctatccgggagtctgaaatgcgggaatatattgttaaagaatatcgcaaccagtttcctgagatatcaggcgagcagcagcccactggagtgcattttaaggttgaattgagagaacttgaccctgaggcacacacctacattctgttaaacaaactgggacctgtgccctttgaagggttagaagagagcccaaatnggccaaagatgggcctcctgatgatgattctaggccaaatattcctgaatggcaaccaagccaaggaggctgagatttgggaaatgctctggaggatgggggtgcagcgggaaaggaggctttccatttttgggaacccaaagagacttctgtctgtggagtttgtatggcagcgttacttagactacaggccagtaactgactgtaaaccagtggagtatgagtttttctggggcccaagatcccacctagaaaccaccaagatgaaaattctgaagttcatggcgaaaatatataacaaagatcctatggattggccagagaaatacaacgaagctctggaagaagatgctgccagagcctttgctgagggttggcaggctctccctcactttaggaggcccttttttgaggaagctgctgcagaggtaccatcccctgattcagaggtttccagctattcctcaaaatatgccccacattcatggcctgagtcaagattggagagcaaggcaaggaagctggtgcagttatttctgcttatggattcaactaagctgcctataccaaagaaaggaattctgtactacattggccgagagtgcagcaaagtgttccctgacctcctgaatcgtgctgcccgcaccctgaaccatgtctatgggacagaactagtggtacttgatcccaggaatcactcctatactctgtacaaccgaagggagatggaagaaactgaggagatcgtagacagtccaaacaggcctggcaacaactttttgatgcaggtcctaagcttcatctttattatgggcaaccatgccagggagtctgcagtctgggcctttctgcggggcttaggggttcaagctgggagaaagcatgtgattacctgcagatacttgagtcagcgctatatagacagtttacgggttcctgacagtgatccagtgcaatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtagaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggtgtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctatagatataggcttttccttgaaagcttgaaaaaaattcgccagtaaaataatctagcttaaagtgataaactaacaaacaaatataacaacaactgaaaaggcactctaaattgtggctggcttccctttctgtctgctattgtatgaagaatactgatgtttacctgtatttgctttgctgtactaaaatgtaatgaaaaataaaagattaataaatgaaacataatgct

SEQ ID NO: 1024 - DNA, 2339 bp, Homo sapiens
  misc_feature: Incyte ID No: 1197030.10
  unsure 69, 126: a, t, c, g, or other
ctttaaggtttcaattcctttcctaaattaaagcccttgtttggattctggggtccctccccctggttngcccaagcatcctcccacccttcctaacaaaaattggggtgggtccttttttccttncattcccaccctccgtggaagaagacaatttgaagggccacaggaagttatttgcctctttgaagcgttttccaacagtatagatctcgtgaatcaaatcctccatgcagatgatgccgtatttaccaagagatcgagcaatcaaagcgttatctgtcaaagcaattcgcttcttattgattttgccataaccacgcttgtagattagttcatttactgacttcagattggggtacccccatgcaatatatggctctacaatcctcagcatgttaatcgaagccttgttgagcttcacaaaggttccattgaagatttgacgaaggcgaagaagctgcaacacctttcgaacctttgggctcactccattgatacctctgattctgatgacaaacgccaatttgggttctgcaggtacatagaagttgccagcttttcttgccatcctcgccattcgaatttcagttctgtacaatctgcctatattccttgtgatagtgctttgctttttcatagataagcttcctccttgcctttcgaagcatcttttgggcaaacttctttctcaggcgcttgatcttcagctctgcgaaattccttctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcatagaggcaaataacttcctgtggcccttcaaattgtcttctccacgaggtggaatgaagaaaaagaccacccattttgtagaaggtggagatgctggcacagggaggaccagatcacaggcttattagaagaatgaactaaggtgtctaccatgattatttttctaagctggttggttaataaacagtacctgctctcaaattaaaaagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaaatcatggtagacaccttagttcattcttctaataagcctgttgatctggtcctccctgttgccagcatctccaccttctacaaaatgggtggtctttttcttcattccacctcgtggagaagacaatttgaagggccacaggaagttatttgcctctttgaagcgttttccaacagtatagatctcatgaatcaaatcctccatgcagatgatgccgtatttaccaagagatcgagcaatcaagcgttatctgtcaagcaattcgcttcttattgattttgccataaccacgcttgtagattagttcatttactgacttcagattggggtacccccatgcaatatatggctctacaatcctcagcatgttaatcgaagccttgttgagcttcacaaaggttccattgaagatttgacgaaggcgaagaagctgcaacacctttcgaacctttggc

SEQ ID NO: 1025 - DNA, 1365 bp, Homo sapiens
  misc_feature: Incyte ID No: 1197030.1
  unsure 1023-1024, 1321, 1354: a, t, c, g, or other
actttttctctctctggccgtagcttgcacctttgcccacctccctgcttgattgtgacgctgtgtgacaccagtggggacctgaggcaacatggtgttaaaggttattgacatggagctaaaatatgcatcgtacactgtagcatgccagagcaagtaaagttactagtgactaaagtcagtgacagcatttctgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgtnnttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagcaagcctgtttcacaagcatttgtacatgattgtcggtaaggtaatccaactttggtttatggaaaaaattgaatttagttgcnaaaatttatttctcgggccttcgcttgtttatnaactgccatgt

SEQ ID NO: 1026 - DNA, 554 bp, Homo sapiens
  misc_feature: Incyte ID No: 158859.1
  unsure 547: a, t, c, g, or other
ttttctaacattgctcacatactgcttgtggttttaggtcttcgagtagcactggaggccaagaaatctccagattctaacctacagacatgtggttgatttttggaagataacttccttctgtctttatctacctcgggaaaatgtattttcaaataccaggcttatgttattgcctcaagcatattatatgtcataagcttcctaaatggatcagtttttgatcaaagatttctgaactctgacctgtgttatttattcacttttctgagactaacatagttgccaactcaacaatgtatgtactctcaagatgactgttttccacatttgtattgatatccatatttaagtggtttggcatttaaattgaggttatgaaatagttttccagagtacaaagaatgtcatgcaatttgtcatcatttctcattactgatatttaataatcagcaataacaggaaagggaaaggatgcccagaggttatcccagtctagctttgtgaccatggttcccaccatcaaccataagaccagtaacagtgntcagttt

SEQ ID NO: 1027 - DNA, 888 bp, Homo sapiens
  misc_feature: Incyte ID No: 229490.1
ctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattt

SEQ ID NO: 1028 - DNA, 596 bp, Homo sapiens
  misc_feature: Incyte ID No: 4832672CB1
tagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaa

SEQ ID NO: 1029 - protein, 136 aa, Homo sapiens
  misc_feature: Incyte ID No: 4832672CD1
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 1030 - DNA, 721 bp, Homo sapiens
  misc_feature: Incyte ID No: 339638.1
  unsure 266: a, t, c, g, or other
gtggcccacagcgaactagagaaacaaaaggagagtcttttaccccctggagttatcgccatcagcaaactgagagctgcctctcttcctctccctgccctgtgtctgtctccacctccttccctctcatccttgctctttcccttttctctttatcccccgccccctttctttctcttcctcctttctcctcccagggaccaaagggagaagggagagccgagaaagtggccctgccatcccctactggaataaccgccgccgcngccccatcactggtggccacatcccttctaatttgtagtggtgggtttctttccttgaagagcagggtacttttaaacagatagaggtaatgggaggattaatattcataggtaagtccaaacggaaaatgtttagcttccttacaccaaaggtctgctgtgtctgagattacactaagttcaagcaacatcatgtcagtgaagaagccattagctgcaggaacacactgagaagtgagggagcctgtctaccagaaggaaatggagctaggatctttgcaaactgctgagtagagaggagaggacgagtaaatgagacagacggaaaagagctggaagagagagactcctttatggcacatttttatcctgagatttccaagcattttatatatattgcatggtaaagaggaattgaaatagccaaaagaaatgaactaaaatgaaaagggagg

SEQ ID NO: 1031 - DNA, 2905 bp, Homo sapiens
  misc_feature: Incyte ID No: 480885.2
gaggaggaagatcaggatgaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 1032 - DNA, 487 bp, Homo sapiens
  misc_feature: Incyte ID No: 342074.1
gatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacgggcagtgaaatttatcagcccagggcagctttcccagtgaaccaatattggaataaaagtg

SEQ ID NO: 1033 - DNA, 974 bp, Homo sapiens
  misc_feature: Incyte ID No: 406992.1
cagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgat

SEQ ID NO: 1034 - DNA, 4604 bp, Homo sapiens
  misc_feature: Incyte ID No: 1852849CB1
aaagcaaaagaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgcggggaagtacagacactattttgataggcaataatcatataacaggaaatggaagtaatggaaacgtgccttacctgcagcgaaacgcactcactctacctcataaccgcacaaacctgaccagcagcgcaaaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcctcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaattgttttcatcggtctttccccttcagaatttcctggaaaaaatactacc

SEQ ID NO: 1035 - protein, 1401 aa, Homo sapiens
  misc_feature: Incyte ID No: 1852849CD1
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTRGSTDTILIGNNHITGNGSNGNVPYLQRNALTLPHNRTNLTSSAKEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 1036 - DNA, 1279 bp, Homo sapiens
  misc_feature: Incyte ID No: 1132829.1
  unsure 1236: a, t, c, g, or other
gtggggtcagccgaaaggtagcagctgattggatgtccaacctggggtttaagaggccaggtgacattcagccggcggttcggggcgacggactctccattccagaaccatggcccaatttgtccgtaaccttgtggagaagaccccggcgctggtgaacggcattggcagttctgtttggaactatctcttagagctttgtgtctgcttaaagctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaatggatgctataaaaaacaggaaagnggagggtaaagatataaaggggcggccgccgattatttagctt

SEQ ID NO: 1037 - DNA, 651 bp, Homo sapiens
  misc_feature: Incyte ID No: 339800.1
tctgcacatgctttccctgcagcctgcaacaaaacttctactcattcttcacaacccaggttaccaaacctcctctgggaagatgtccctagagttttttccagcagagttaactctttcctttgtttgagttcactctttgtgtgtactcggttgtagcatagattatattgaattgtaattatgtatttttaatgtcttttttcctcagtagggaaaactaagttgcgactatctttgggacagagaatctggcttatttacttttttttaaactgcagaaccttttatatagttggttctctataaataattgatgattgaatgaacgagttaagtcaagctttgaccaatccaagtaagtatccttcaggtgtcctcagtcctccaagcatctgcaccagaaagttacccccaaccccaccaactctttacagtccacacaaagaaaacaaaagaaggccaacaagcaaacaacaaacaccccagaaacagatgtgtgcataatagtacacgtcctggctaccacagaagaaatatcaggaagaaattgtaagatccataagggcaggaattttttgttggttttgatctttgctgtatttccagcacctagccaagtgcctggcctacagaaagtgctagattgaa

SEQ ID NO: 1038 - DNA, 1357 bp, Homo sapiens
  misc_feature: Incyte ID No: 1399492.1
  unsure 36, 45: a, t, c, g, or other
ttcagtatagtgtagatctactgtgtaattaatttnctgtttctncgaggagctgtgaaaccaaaggacatataaaactgctcttttctccctgtttctgcctgcagcttggtcctaaatgtgagacaattgtgaaaagtggaggacagagccacctggttaaatacagccccagctttctggtgagaggactgaaaccaagatgtgtcaagtaactagaatgtgcctggacagatactgtagaaagcaaaaccataaagttgttcatgagcttgtggacgcacctgccagctgtgaataagtggctctaatcccgaacaacttacctaaaaagagcctgagagcttgaactgtgcaatggcccactttccagtcctcacttgaccactgggttgcacacactccagagatctctcatccgcagtgtcaaggctttcaaatagagttatctgggcatgtctaggcaggtcctcctttgctaggacgtgcccttttctgtcccggaatactctaaacttggcattttggcagcgtgaagttttcccgttgtgactttctccttgttcccttttctcctccttctttgcagacaatgagtagccactgctgtttgccctgggcccatcaagtgaagaaaatctgctcttaggagccctgctttcctgctgaaggccctgaaatcacctgtgtttccaggccacccgctaaccaataaataatgctgccctgatgtgggggaatttagctcaagtggtagagccgcttgcttagcatgcaagaaggtagtgggatcgatgccccacattctcccaagctttattatttatgacatcgtgtctccataacactcatggtctccaaacccaagttagtgtctgagaacaggatgcttgctattggttacaagacgtaggagcagcaataatagacggcctggtgatggctccctcttgggatccagtaatagggtagatctaccatgtaattaattctctgtttctttgaggagctgtgaaacccaagggactatatacaactgctcttttctccctgtttcctacctgcagctattgtcctaaatcctgagacaattatgaaaaagtgcaagggcagagccaacttgggtaaaatacagccccggtttttctgctccaggggacagagttttgaggcactgcagaggaacctggccaaagtatgagacccatatattgagagtaacagagtgtaacagttcaaaaaaaatccaaaatgtttaacagatttatcatgggtcttgatgacatgatggaatctctctactctctggagcttattatgtgtggtaataaatttactttttaaaagccaaaaaaaa

SEQ ID NO: 1039 - DNA, 6291 bp, Homo sapiens
  misc_feature: Incyte ID No: 013039.2
cggcgccttcggctttggccgcccggcagccgccgaacttgaacgcttttctgaagagagttttccccgctcatcttggggttaaaacctcgaaaacccgccctctgtttgatcctgcgtggctgcttccagtacctggcagttcctctccccgggcgagttaaccacctgttcagtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgagggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcct

SEQ ID NO: 1040 - DNA, 975 bp, Homo sapiens
  misc_feature: Incyte ID No: 399626.1
attttgaagtactcacgtgaagactttgtgttggtgtgttcagagtctctgggcagagaaaaacacccactccgctacagtcctatcctgcttttgagagcctgtttgcaggttctagcaggggagcactcgtatatccttgaccaaagaccagtcctcctctctcagggatggtcgtcttcaatcgagcatgcagcttcgggacagatgcatgtggagcggtgagggaggaaggggacacccacctagtcagccagatcagccaaatcaaccctggtgatcaatggggtgacagatgtcacagccagatggccctatcctgcttttgaagaccatgtagtcctcctcagtttgcttctttccttctccatatccagttttgtcgtcaagttaggttctttttgaagagttagttgtacagtggtcagatttgttcaacttttggataagcctttggggatgttggggttagattagtggctttggttttttgtttttgaccttcacccagtacagtaaagtggaaaaccttgtggccatcttctttttcatattttcccaccttttagtttttgtgtgcacatgttaagctttgtagtgttgccaaatactttgtgtcagcctgactccttagtagtatatggatctaaaccaaatttattgaaaatttcagtttatgagtaccattcagtagcccttagtcatatgtatgaataaggaatgtgtagttttatagaaaggattttcatttttggttcagtttgtgacctgtgaggaatatccttagagctgctgatgtaaatttggagaatcctcgagttagaaaagtagggataagaaaacttgtctaccttctccatgtcctttgatggggccaaaaaggaaaaagaagagtggtggtggttggtgtagtttgtcttttcagtcttacgggaaacaatgttccatgggtggtcctttgtaagcctatggagg

SEQ ID NO: 1041 - DNA, 1325 bp, Homo sapiens
  misc_feature: Incyte ID No: 365070.3
  unsure 1242: a, t, c, g, or other
gcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgcctggccaccgtgtccacccacaagaagatccaaggactgccatttgggaactgcctgcccgtcagtgatggccccttcaacaatagcactgggattcctttcttctacatgacagccaaggaccccgtggtggctgatctgatgaagaaccccatggcctcgctgatgctgccagaatcagaaggggagttctgcagaaaaaacatcgttgatccggaagatccccgatgtgtccagttaacgctcactggccagatgatcgcagtgtctccagaagaagtagaatttgccaagcaagccatgttttcaaggcacccagggatgaggaagtggcctcgtcaatatgaatggttctttatgaagatgaggatagaacatatctggcttcagaaatggtatggaggcgcatccagtatttcaagggaggaatatttcaaagcagttcccagaaaggcctgatggagtgagaagaaagtccttggtgtttgcacttaaataaaaaccttttcagtgatgcagccagacagctattgaccactgtctctttgttgaagggttcatagcagccctgccatccctgcagcagaatgagagagggtgaacagggaactctatgctagatttgagattaaagtggtcatttgcagatctccaactcacacagatacttcacgtagatagtctttattccattgtattcaatccagactcatcgattcagaaatcatataatagctggtggtcaaaatgacatgttgagatcattgttgtttcattgtttaaggnaaaaaaaaaatgcctgtacctacaatgtgattgctttgtattgtgagagtatcttgttgcttgctctgccaaatgcagtcttg

SEQ ID NO: 1042 - DNA, 764 bp, Homo sapiens
  misc_feature: Incyte ID No: 365070.1
acgaagcagctgactgtgcatcacgcagtcacaatattgtttttagggtgagggtggaggactgtgtgtccgtggattactcctcctgctggtggattgcagatgcattattaggtcatactggctagaatgcagcttttctcccaccataacatgaaaacagtgtaagaacatagggtgctttgtgcatagcccttctctatgtaagcagccatggcagtcattaaagagaaaggagtagctttgacattaagctccccagatccctgctgctcatacttctggcaaggggttcccctctctcatgcatgaacaggggcatccaaaataagaagctctccattctgtggtggggaaagcggagaggggagtgggtgaagctgggaaagtaaaggcagcacgttacagaaggaagaaaggaagccagtaactgagggcccactgcctgcccggccctgggccaggccctcaacagaagccatctcatttaagccctgcaaccaatgagatgcacgtcatcattggctcttacagacaagaaaactagactcagaggggctgagtccacatcccagacagctcactgcagacacaggtggagtggttcctacaagacatccagttttaacaacaaaagagttattgaaatgcatgggtagaaattgaaccaggaaaatcagtaaagtgattgtaaaaaagaaggactagcttgcctggagatgatgtttcttgcttttggaaaaaaaaaaaaggtctctgaaatt

SEQ ID NO: 1043 - DNA, 1418 bp, Homo sapiens
  misc_feature: Incyte ID No: 1383263.10
  unsure 382: a, t, c, g, or other
gaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacnatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtagtccctcgatcaaccaaccctcagctgctgccatggaccccaggtgcaggccaccaggcccggggcctctgagccccactcccgctcaaggcctagcagtgagtccagccaacagatgcttctctccaacagactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatgtgagtatgtgattgagcagctcctcccgcccctacccggaggcctggggatagaagagtcctcccaggtctccagctctccctcctccctctcattgtccccaggctcctgggctcacaccatggggaccgtctgttctcatgggacgcctgagcagggtctggggggaggggcggtgagcacaaaggagcccaggcggtggagctgggggcgggagccgggggcccacccaagctggcgctttccacatatgttctcactggtcctgagcaccgccctgccaggaaggggttgctagctccacagtatggagaaactgaggctctgagaggcaagctggccagaggaccctgccaggccttccttggactgagcaaggcacgtgggctccaggcgggagcatctgtgtgcagggtgggcagtgctgggccttggagattgcagccgtgaggtttccagggcgc

SEQ ID NO: 1044 - DNA, 2936 bp, Homo sapiens
  misc_feature: Incyte ID No: 1383263.14
ggactggcctggggcgggacgtgggcgcgggggcgcggcgtgcggcacgctggcaggggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcaaaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaaaaagatcttagttctgtaagacatttgaaccattctctggctaaaggaaagaggtgtctgtaataatctgcacgaacatgagacagaggtgccagctggcctttctagtcaagaagactaaggtcaatatggaagtagacataaggaaaatagtcttggttattgagttgcagtcccgggatctccacagatgcatccagtatacttgtagcggctacttcatccagatgtcggaagacagagtttagaacctctcttaaacgcttggtggatgacttcttatgcggctgcaggagcactgcctggaagttcactggtagtccatacctgagcacggactccacaaacactctcagggccttgatgtggatccaggcaatgaaggcttcactgaagttcaccttgagccagcgcagcagggggccatactgttgcttcttatcagacagcaatctggccatctcctccctttccctttcaatttccttctcatcatagtaaaattcacgaacagtgaacttgttttctttggccttggttttgaaatcttcaatcacttttcgaaacagagtcacagtgaaaaggcccccttccttgtcctcagtaatgagtttggt

SEQ ID NO: 1045 - DNA, 505 bp, Homo sapiens
  misc_feature: Incyte ID No: 406707.2
  unsure 459, 463: a, t, c, g, or other
atatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttgggcgggattatcatgggactcctctggcagaagttggttctgggaaganggcnctgttccctctccatccttgtacggtctcctaactattgagg

SEQ ID NO: 1046 - DNA, 731 bp, Homo sapiens
  misc_feature: Incyte ID No: 406707.1
gttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcaggattttcttatgtcacagccattactcatgttttcgttcttttggctgggattatcatgggactcctctggcagaagttggttctggggagatggctctgttccctctccatcctttgctgaaattttttggatttgcgagaagacagctgccccagtgaagactgaggatttggattagtatgcttcttccaaattctccaagaagtaagagacttgtgagtaagctcatatgaggaaagaggaaactacggtaccagagccaaaccagcttttaaaatgactgtgtatttacattatcagacaaatgaacttgtttaacagaacattctccagttccttgtctgacgtcttctgatttgatgttattattcggtcttaaaattatacctggggacaaaggggaatagccatactatggccctatgattgtctcagaatcatttcactgaatttgtttgctgtctcaaataaaaactcccctctttcattgttattataaggagggaaaa

SEQ ID NO: 1047 - DNA, 1941 bp, Homo sapiens
  misc_feature: Incyte ID No: 1051954.7
agtgccagaaactttctataccttgctttcagaagagacagcattctttgctagccttccaattttgagctcagtgcaaaagccttagaaggatccagtgcataggtcttcatgctttcctttcaccccaagtgattatcaactttgatttttctcttcagcaataactcacttggtgtacccctacctcaggtacagcttttcaactttgcagcaaaactgtactttctagttctttttgtatttcagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 1048 - DNA, 413 bp, Homo sapiens
  misc_feature: Incyte ID No: 102564.1
  unsure 402-403: a, t, c, g, or other
gtaatattaaatagcatttactgtgttataccaagacatatatgtttatagagaggaaacataaagaaagtacaaggggcatgaatgtacatggcatatatccttgaatgctgagtagtgtggtgtcaccagacaatgggttatgtggggaagactgctgagaggtgccaaagggatttgtatatgaagcaaagcgggcttgggggttgggcttcattttacaggcctccaacatataaggcaaaacttattgaatggtaaatgagtatagcaaggatgaattttattgtatgtaaattatacctcagtgaacctgacctttaaaagaaagaaaacaatgaggttgaagaatggattttggaagctaacaattcagaagtgtttggtgactttggcaaaacnncccaaaaaaa

SEQ ID NO: 1049 - DNA, 1008 bp, Homo sapiens
  misc_feature: Incyte ID No: 233312.1
aaacaaaaacaaaaaaaaaccagatccaaagaaagtaggtatagactcacaaatgataaaaattaatggaatttcctgggaacagattactatttaaaggatctcaagcttttatgcagcttttaaaaatattcaaagactctttacgaactccagaactaaatcagacaagtcatttgtaactgactgtcaagtatgtgaaagtcagaggaggggatgaaatcttagacactagctaacggggccaggaaacaaagatatctatgaacacttatataaagcaatatacaatacacagagattcctatgattcaaacatcattaaaaacccacagagaacaataagaggtagttttaaatgaggaaagcttgctgaggtaatgtttttgaataaggtttgtaagatattagctaagtcacggaaacaaggcaagagcgtgtaaagtgaaggatcctactgtgctgggggaaggacaccatatgtgcttagctgcatgactgtatcagtaaatgatggagaataaaattggccccactcaggaaaacactggaagcccagaaagcaagtagcctagctatgcataatagttactgccaatcagaagttatgaggtcttacaattcatctaaaactgctaatattcacaatttgaattttcagcacacccctggggcaaagtagaagctcactgctccaagaggtatgcaaggtaaaaggaaacacagtttgagaataaaacattcaccacacaggtcaacacacaaaagtgttaatgcacacattgaggagttgaaaatacttttgaattttaagataataatttatatatcgattaaaaaagatttcaaattcaacatgctaaattttatacagtacgataaactaaaaaggaaaaaattttacatctgtgtgtttaataaaatgttttataattttgatgcttttattctaggctttgtacaagctttacagtgcagcagcaacccacagacatctgtatcatcaag

SEQ ID NO: 1050 - DNA, 2651 bp, Homo sapiens
  misc_feature: Incyte ID No: 335568.1
ccacgcgtccgcgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccggtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgcctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaaagaaattgggagggtacaggcaacaggagaaaggaatcaaaccacaaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaggacaatggttattgttaaatatagtgatcattcatgtctaaaagattcattatttatctctaaagatttctaa

SEQ ID NO: 1051 - DNA, 704 bp, Homo sapiens
  misc_feature: Incyte ID No: 407739.1
  unsure 272, 316, 346, 378: a, t, c, g, or other
atttttttcacttacgattctctagtttggacatttggtagggtcagtggagataatttgtctctgtttcatctgctgccaattgaggcagtttgacttaggctcaagactccaagatgccctagcttcctctctggggccgtggtgctggttgtcttcttgaggcacatcagttttcatcttggttctcgtctatctctgcctgttgacactcacccttcaggacttctctcttcacgtggtgaatcctctctagcaggatagcaattgancaaaagtagaaatttccagccctacttaatatcgaagtctaganctggcacagcatcacttatgcctcattctnctggtcaaaccgcatcataaggctaaattcanggagagggaactagggatgctatttttgatgggaggagtgacattgagcattgagaggtgggaagaatttttggtgattggatttgtagaaactgtggttaaatagttgacggattatttgtatataagtctgtgtcccttccatggtagttccataatgttttctgcctggagcaactagtcttgaccgtatctgctatgcatagcacagtacctggtacacaaaaagatttcagtaattgattgttgaatgaattaataactgtcttgccattttcagtactttaattatttttccaaaaagtggatcaaatgttcttttttta

SEQ ID NO: 1052 - DNA, 938 bp, Homo sapiens
  misc_feature: Incyte ID No: 272273.1
gtgacctacaacgatgaaggcggcggggaagaagatacccaagcttttgacattggcacattaaggaatccagaggcaagagaagacagtaaacttagacgggatgtaatgcctgaaactatttttcagataaggaggactgtgcctctgtgggaaaatattgatgtacaagattttatccatcgaagattaaaagaaaacgacgcagacccaagtgcacctccatatgattcgctggcaacgtatgcctatgaagggaatgattccatagcagattcgctcagttctttggaatctctcacagctgattgtaaccaagattatgattacctcagtgactgggggcctcgtttcaaaaaacttgccgatatgtatgggggtgatgatagtgaccgagactaagaggattgtttgacttaatcaatattagtggaagtactgtctatgttattagattgagtggcctgcattctcttcctgggaggaaatctttcaaaaattgaagttacaaacaatacgtagatgttgtcaagtagggatttgcttaatcagtaagtctttgtgaatgaatacgaatgatacagatttttaaaaaagtaataaccagttcaccctctttgcctaacaatctcggaaggaaaatatatcacatcaataatcaataaaaataagtaaaaggctttttgtgccttttcttaggtataataatttataaatgttttcttaactgactttcagtcacctttacaattaaactaaatattgtgcaaccgctttgtaaattaatatgaagaagatatatccctaatgaaataggaatgactattactgccatatttatttagttgaagaatgtctttgtgttaattcattcatatttttataaatgtatatttatatttttgtatttttatgaaataaactagtatttataaaac

SEQ ID NO: 1053 - DNA, 4048 bp, Homo sapiens
  misc_feature: Incyte ID No: 399133.9
gggggcggggcctgggcgcggcccgggctcggcagctctcggggaagctctgctctggctccggcaggcacaggcggctcgggaggtgcgcgccggctccgcccccgggccccgcccgtccgccgcgcgcccgcgcctcccaattcccagagccggggctggggctctaggctgccgcggcggctctaggctgggctgctgggcgcgaggccagggcgggccgggagaggctgcgccggcggcggatcgcgcagagggcggtggcctgggctggccgaaccatggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagacccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcccgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagcccgttaggcctcccaggtccttaggatcagggttgcccccagaaccccttcccatatcctccattctccgccctgagttcctacccaggctgcctggctggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctcctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaatcatgtctctgttgaatttttccttttaaattttatcttttcagaattatatatgtattgtttttaaagtagaatagttttttttttgaggccaataataaataataaatgcaggctcctactctgatcctctccaaattcaactctcttaactgtttcttcaggcatttgaaatccatggtttttcaaaaccatgagcatgcttttagtcctgtttattcgtttttctacattagatgtccctggctggcatcctctgggaggagggcggtcacctgcctcagtctcctggcggcatcattccagtgttacgggcatc

SEQ ID NO: 1054 - DNA, 864 bp, Homo sapiens
  misc_feature: Incyte ID No: 246727.11
  unsure 847, 856: a, t, c, g, or other
gagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttcccttctaaccattcttttatgtcatcaagagttgcatcagttgggaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgttattaaattagtttctacttgatcatttgttatgccctagatgtgatgtctganattttctgnattatact

SEQ ID NO: 1055 - DNA, 2742 bp, Homo sapiens
  misc_feature: Incyte ID No: 246727.17
ctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaacagtttcttgattttgtttcttctttttgtacccaaagcatttaggaaagaactagaatattagctattgacgatgggcctttcccacaggccattaatggtgtctcctaggctggctttgtatatttacacaggaaagttggtaacactagaaataattacttgtcacaaagctttcctttttttttctttttcgagactgagtctcactcttatcgcgcaggctggagttcagtggggtaatctcagctaaatgaaacctctgcctcctgagttcaagcggttctcttgcctcagcctcccgagtagctgggattacaggcattgaaccaccacatccggcccagaaagcttttcaataccgaatgtagaccagccaaaatcaagagacttactgatttctttttgtgaaacttgtatgatgctggcaggtcatatcgaagttctgctataatatctatcttgattttccattctgcagctttcttttgaacatgttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattgaaccatgtcaatatttgttaactcaaactcttctgcattcctattaaatatttccaatgcgtcttcatctatgtcaaatccaacacacaaccctgctcctaacattgcagttccgatgctaagtactccacaaccacatcctagatctgcaacgactttattttcaatgtcatcataagtgttatggattgtatagagcatacatgctgcaatgtgcggcctggtaggatactgttccagaagtagcttgggcttttcaaatccatccacttgttgcaggcgactctctagttccttaagccttactttcttcattttgttttaaagtatggactcgtagggtttgaaggcacaggatctctggaggcgacccgcacctcggccggtgccggaagcgccaggcc

SEQ ID NO: 1056 - DNA, 2288 bp, Homo sapiens
  misc_feature: Incyte ID No: 230367.2
attaaaacagattctagtgcttactgtttcaaatgtgtactatagtattcttattctctcctattacagctcagtaaacaatttgccttccatgtcccaactgtaatttccactgtttttcactggtttataatgctcagtaactatccactgcacctgaatatccgcctgttcttttgttgcactgatcagatacattccttttagggtactaaatttggatctttcttctttgagcaggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcctatgtgagactacattttgattttttgtgtggcatgcagatgtcatgaactatagtgcagcttttagtgtgttctaattttaattgttttatatcctgaaaccaatggtgaaaagtaatttcattgagggtaccttttcaatgcctgagtagcatacagaatcatgattatgagactttcttttatctttctttataaaaatatgtggtttttttgttgaaagttttggtctctttaaattcagattttgtcttaggacagtaaaacccaggttgactgactcaggaaacagttgtctgctagtcactcataaatgtacggtcatatgttcactcttcttaaatatccaccttttataacacaaatgtaaaatagtatcagtctagccaatgatgaactctggaatccacttagtcttcagtaagtatgtgctgttcctctaaactttgccctgaagccagggatcttctcctaatgtatgtgacataaaaatccattttccatgtactcttgccaactgtctgataaggaattttgtgtgtgttctttctgactggagagtggaggacatctaagcttgtgtggcattggtccaatgattgccatgcatgacctgtaacatcaacagctcacagaatcctaaggaatcatgtgagaaacaggccttgggtcttatgagtcttctgggacctaaggtgataaaatggatggcacagaatggcatgtgatcaagcatggaggtgataaggaaacaattgctactctgtgtccatcagtccctgcgatgtctgtaaatgcacagtgtaatgtgaagcactttcagaatatgtttgtgtgtgtctgtatgctgagtgttttcttttcatcctctcatgtcggagttcatttactgtcaatttaaaactttcctcttgtaaaaaggtatgagtttggtgccattatgatttggttgtggctagattatatacttgtgaagtagattctgcctgtagccattatttatatgcagccacttgaagaaaacaaacatgagataagcttggtccttgagtttaaatggcatatttagctgggcacataaagagctaatcaatcttttaaaatttgcagttgatgaagagctgcttatttttctcttctacatggattttatagtcggtttcctttaattcctactttagttggccctagataatatgaacaggaatcacctgcctggtagagcccagtgttttccaaggtaataggaattgatacaaaagaattacttatctttgttgagactcgaccatgcaatctgacagaccttttaacctacccttactttgctttctccatct

SEQ ID NO: 1057 - DNA, 742 bp, Homo sapiens
  misc_feature: Incyte ID No: 1383039.18
cgcgatctagaaccttaaataaaactatttaagacattgcattttccacttacaatacagtgtttataaagtgcaatgttatttccttcccctgtgcatatgttccatattcaagtattgagaatgcccagtaacttactatagcagcttaactttttaaaactgccacagaatttgctacgaatttaggtccttcaaatgttttaaatgtgtggaacaatgctacatctacacttggttggcttaatcaacctcttcaatggtgggccctgaggaagcaccaccagagggaggagctccaccaccaggaaatcccccaggcattcctcctggcatgcctcctgcactctggtacagcttggtgatgatagggttgcaaactttctccagctctttctgttgatgttcaaattcttccttctcagcagtctgaggaagagaaaaaggaattactgcaagttcttttaatgttaataacccttctttctccctgacgcaatctgatactaaaagtctggcgcaaactcttacaagagggccactaccaacattaaaatagggccttattcttccttaacatcttgggtcactcagacatccaaggaaggtagttgccaacaccttgaattctggtggaaaccgcgaatgttttggaccattcatcattgtgaccctatactgaaatccagctcaagcttggtttaccatccccttcccctccattgagtgggggaggatattt

SEQ ID NO: 1058 - DNA, 1229 bp, Homo sapiens
  misc_feature: Incyte ID No: 1383039.17
cccacgcgtccgcaaagctgaagatgagaagcagaggggacaaggtgtcatccaagaattcacgttgagtcctatgccttcaacatgaaagcaattgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaattgctttgagtctttaaataatctcccaggccagctggtgggaga

SEQ ID NO: 1059 - DNA, 391 bp, Homo sapiens
  misc_feature: Incyte ID No: 027704.2
gcatgtatagcatttacactatcgtgtatatacaaatatatagcatatgtatagaatatactgtattattgtacatatacatatgtacaagtatatatgtaagctcaatgtcttatgatttcattctgacctattgccaacttcattacacacacacacacacacacacactctctctctctctctctctctctccccctcttcctgtcttaaaaagaggttggcaggaacctgtgatacctgttgctgagaaagctatttccgcccacaaagaggcaagtctgcagataaaaatgtaacatgctaaggatgagaatagatagaactggtccctgatgacactgtttagccaaggatccaatcctgaatctacccaatcccagactgcctg

SEQ ID NO: 1060 - DNA, 590 bp, Homo sapiens
  misc_feature: Incyte ID No: 346900.1
ctggcacttactggtttgtcttttttttcttacaaatagaatacctattatgttggttgggaataagaaagacctgcatatggaaaggtatgtagcttttataaagtcaaatctaagatgatttagtcactgaagtatcattttaattattgttctgatgtcaagaatatttttagctgtagcatttttatccgttcagaggtgttatggtcgtgtgcagcagaagcaaaagtggaatagaaatctcacattcctctagaaaagagagagcaaactttataggaaactacctttaggttatctgccactttgcataaagcaaattctaaaaagacatagtgctcatttatgcagcaagtggtttttgagtaccagggtttgggattacagtgaggagcaaaggaggcagatgtcccctgcccaggcagcttcatgtcagagaggaagagactctacagcctgcatgcaagagaattgagctttcaggctctttcacaatttcccctggccttgggtgcttacaacctagctgtaaaatagtcaattgttacagatacggggagtactgggaaaataagatcatgttctct

SEQ ID NO: 1061 - DNA, 2100 bp, Homo sapiens
  misc_feature: Incyte ID No: 249813.1
atttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaaacaa

SEQ ID NO: 1062 - DNA, 1070 bp, Homo sapiens
  misc_feature: Incyte ID No: 411357.1
cccgctatctccccgacctaccaacccctctctcctggctccctaaagtcaccgcccccaggttgaatttcccagatctgtgacgcttgcaggacatgcatgtgtgggaggctgatgggaaactgtggcctgggtttgattatgagtcttgcaatcatccctccccctgtttctgctggagggcaggggacagctcttcctgaccacacccccacattgactatccccagaatacccagcaaaagcccccaaaaggagagtcagagaaatgagggaggtgggggcccaatcagtccacatctacttagggtcgccccatcaagcacttccatccccaaccctttcaagtcaacatccaaacaaaaagaaatcacttccaaggacggagcagctcaaagcgcagcttctagctggggttccaagaaagcagatttttcgaaatccttctgcagaaggaagcaaagagattttttagaaatctttctgcagaaggagaaggctggagctggggaactccagaattatagggaagcctcccaccacgctcatcccaaatttccggatgctataatgccaggcttggggaaagaggagaatttagttggttagctggtgcgtgctctcacttgcatcctctctcttcctctttttttttttttctcctctctctcgtggctcattaaaaattgggggtaatttagttgtgcccgtgggtgagaaagcaggagaagtgtgcacaatgaggcccccgtgactggagtcctcttcagggtttagctctctagtgtactactatctgcagatacagatttttggtctccaagcattcctttgcaggagaatttggccctttagcttcccctctacccctagtccagggctgaataagaatctatgctgacaacgtactgtcattatttgaggaaacgtaattagtcactagtgtgggtagggggttgggcgagattgcagaaggaatgttcatgaatattgaggattttcagctctaaggggggactttgtaaacagctttagtagatagaaccaggccggctggctgtggtggctac

SEQ ID NO: 1063 - DNA, 960 bp, Homo sapiens
  misc_feature: Incyte ID No: 068902.1
gctttggtgcctacgtgcatcacacagacagtttaacacataattcattatcagcaagcggtgactgcccaggttttgcctgtggggaaacagaaaggttttgactccagtctctgtcttctgaagagctggcagtcacaactgtggcagagcctggtgtgtggcagctgcgtgaggctctcctggactgctgtggaggaaggggccctctggcaccccaggagcagcctgcccctctgtctgcctctgcatttagacccttagcctccttgcagagccacctcctggtcattagcgttaaagctcttctctcctgatgtagttttcctcaccgttcagtaaatgggcctgctgcttgtgtttggaacagagatagaagctgtagctcccacgtgtgtgtggagctggtttgacttttaaaaaattgtagtaccaaaaactatgattttttgtgtgttatccacaccatcaaggctgtatcaccgagtatctgctcattctgaaagtgtccatcctttctgaattgaaatgaaagagcaggagaaaccgtctgtgtccagcctgttagaggtgttacatttgccctaggtgggctgggcagaaggctgttctgctcgggagcaacagtgtccacacgtcagtttccagagcccgggtcgccaggatccggctcagagtgtgagtttgctcaggtgtgtgctgagcacccctgggtgccagactccgggcaggtccccgccgcagccgcgtcagcagagcaatgtgatcattgctgggactgttcccctagtctcagtcagttcactagggccatgcatgcagtgttcagacaggagattctcatgaaaaatagaattgttatcctaaaattacatgagagggaatgcttataagtttatcaaatagtaaaacatcacaacacaggaccgggtgcggtggtgcacgcctataatcccagct

SEQ ID NO: 1064 - DNA, 2327 bp, Homo sapiens
  misc_feature: Incyte ID No: 210133.1
gcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccactctgggcctcaagcccttcgcgtgcgacgcgtgcggcatgcggttcacgcgccaggtaccgcctcacggagcacatgcgcatccactcgggcgagaagcccttacgagtgccaggtgtgcggcggcaagttcgcacagcaacgcaacctcatcagccacatgaagatgcacgccgtggggggcgcggccggcgcggcctggggcgctggcgggcttggtgggggtctttcccggcgtccccggccccgacaggcaagggcatagctcgacttccccgagggcgtctttgctgtggctcgccctcacggccgagcagctgagcctgaagcagcatgacaaggccgtccgcggccgagctgtctggcagcagaccacagcacttcctgcacgaccccaaggtggcgctggagagcctctacccgctggccaagttcacggccgagctgggcactcagccccgacaaggcggcacgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcacagtcttcgtgccttagctcgggggtcgggggagaaccccgggacgggggtgggatggggtaagggaaatttatatttttgatatcagctttgaccaaaggagaccccagggaccctcccgcctcttcctgtggttcgtcggccccctaacgcggctccgcgctgctcttagagggggagggatgtcaactgtcggggcactcctagccctacctccggcccttgcgagccacacccattctcactgtgaatctccccgctggggtcggagcgtcgggcagagttggggagtggggaggggactgagccggccggagggccccccgaacccccgatcccatccaaccccgggactgataaaagtgaagttccccatttggcacaaggggcactagccccagggccaacccttccttcctcagtcaccaagggcggggagattctggagtcggaaggcgaagagcctacccccaggtctcccacactcccgcggtgcccctcccttcccttccctgcggccccggacccactatttattgcactgcgccccggcggccccccactcccgaggcccacggctgggctgggctggaaacgcggtctctttagctccctcctcttcgtttgtaataatttcctaccttgtaccacaggctcttccagagagccgcttccattttctatactcgaaccaaacagcgaataaagcagtaaccaaggaa

SEQ ID NO: 1065 - DNA, 400 bp, Homo sapiens
  misc_feature: Incyte ID No: 430665.1
cagctggctccaggctccaacgtgccttccagctgcctgactgcctcttcgcctctcccgtcatttcttggctcgaaatggaccccaactgctcctgcgccactgggggctcctgctcctgtgccagctcctgcaagtgcaaagagtgcaaatgaacctcctgcaagaagagctgctgctcctgctgccccatgggctgtgccaagtgtgcccagggctgcgtctgcaaaggggcgtcggagaagtgcagctgctgtgcctgatgtggggacagccctgctcccagatgtaaacagagcaacctgcacaaacctggatttttttttcatacaaccctgagcatttgctacattcctttttctattaaatatgtaaacgacaataaaacagttttgacttg

SEQ ID NO: 1066 - DNA, 977 bp, Homo sapiens
  misc_feature: Incyte ID No: 902525.1
tgcccgctgagcagcctaatgccccagtgcccttaaggcattgcttcaaagatctgagttggtggatgatgcagcgcttggcacggtgccggtgacacatccccctaagtgttttctcagtgtgagtcttcatcggcttctctgctgtgccttcttcagcttgtttgcgagttcctggttcatcctgaccaccctgaaaggccgcccctgggactttgcataactcattctgtctcctggtgtgtaagtctctctcctggttcccagcaggaagtgtaaggaatgaagtgcttgtcctggactcctgggctgggaactaagcacctagtggggactggactaggatgacttgggccaatttcttttcaggctgagcttgggatttcagatcagatctcttaggacagagcccttgggaattcccatggtgtgaatgtcctgggccagcgggaatggctgctcgctcatctcttccaagggtgatggtctccactccctggatacaccagcctgggaggtgccttctcaatggaaagacaaaaagagcattttctcgctccctttctaactccgctgccaccatagctcctgtgaaaaagcttgtggcgaagggggacaaaaaaaagaagaaggttctgaagttcactcttgattgcacccaccctgtagaagatggaatcatggatgctgccaattttgagcagtttttgcaagaaaggatcaaagtgaatggaaaagctgggaaccttggtggaggggtggtgaccaacgaaaggagcaagagcaagatcactgtgacatccaaggtgactttctccaaaaggtatttgaagtatctcaccaaaaaaatttgaagaaaaataatctatgtgactggttgcgcatacttgctaacagcaaagagagttacgaattacattacttctagattaaccaggatgaagaagaggattaaatttcatttatctggaatattt

SEQ ID NO: 1067 - DNA, 804 bp, Homo sapiens
  misc_feature: Incyte ID No: 256841.1
  unsure 156: a, t, c, g, or other
gtaggtcatatcgccgcggtgagttttgctctgtgttgtattaagtctgcgctaactaggttcccagggcttctgtccctgggacgtggggtccccacagacctggaaattctccggcgtcttcctttgcccagagcaaattgagacatccccgtnagagcccgagggtcgcttccttttgggtttaaagtcgtcctgaggctggtctcgtccccggtctttctgctataggtcaatgtatacactttctgttgcgtagttttcctgctgaaaaccttgttctgactcctcgcgccccgcgctttttaaagtcttcacccgcgatgtggattcttgcccagggcgcctcccagcctccccctcctcagccccgggagcgccgcgccgcagccccagtcccggggaggccgagtcctctgccaggtcctgggatcctgcagaccccatcctggtcctaaggcgccgtcgcgccgccccgcaccttcctcctcatgccggggcctgctgctccccaggtctcccctccgcagtcaccgctttcattgaacctgcactggggaggtcccaggggcctgtcctgcggcacggggtcttcttgcctgcggagctccagggcgtggaaaatgcgctcctccgggatgcaggcgtcttactccaaaccgtgttgcgattgtgtgggccaaaggaatcaggagacagagagcagtagaaaacctgaggcagagaaaagaagaataagaaaggcccataacagatggcaaaatagaggattggtgagggatatgccaagagatggccagaagt

SEQ ID NO: 1068 - DNA, 910 bp, Homo sapiens
  misc_feature: Incyte ID No: 206344.1
catgtatgcaataaaaaataaaagatacatacacaaaattctttaaatgtcccacacacaagacaaatacgtgttcaaatacatcagtctctgaagcctctgcaccactctacacgctgctccttctgactagtaatgccctcctgcccctcctgtccacgtgtcaaactcccaatcaccctttaaaaccagattgaattattttgcttctgtgaagctttccctgactatccccgggatagaataatgtttccactagtgttttgtcatttactcgctataataagaatacgaaagaacatgtatttttgaaaagtatctgtgatctctaatgagcttgtaaacatcttgaggaatagagactaagttttgcttctttgttcccccaaagagaactttattaataacatttaccatctctttagagagagggtttttcccatctctgtgagaaagctccagaatctacaaccaggaataagtgttaatgggatagaaccaatgtagagaacagcatatgatatgtgaaatgtactttattattaatacgaattcagtgggctcacagaatgaacctttttgccaaactggggggaaagcattttctgtaaaggtatctttagaaaaatatgtataatttgaaaaatggttatccaaatttaacatttgtcatataaaaggctcataaaacgtgtgtggctgtgtttctcaaaattgtggggtcaattggtcacattatgcctagacattctggttttgttgcttggggttaataatggttgtggtcttatacagaaaaggaaatctggacatcttgcccctgttattaatacacctgtcattactaataaaagtggtttgttgatatgctaaataggttgaaaaagctgtcactttgcatgaaattaac

SEQ ID NO: 1069 - DNA, 1011 bp, Homo sapiens
  misc_feature: Incyte ID No: 107309.1
  unsure 433-436, 445, 447, 454, 456, 463-465, 472, 495, 498, 662, 939: a, t, c, g, or other
aaaaagaaagcagaagctgcattatcaatataagacagagtagaatttcaaactgaaaggactaaaggacacagaaggacgcttattattaagtctggttatattacctagaaaatgtaacacaatcgtttatgtagttaactatagcttcaaaatatgcaatgcaaaatagtatatatatatatatgggaacattgttacatctacaatcatagttgggaggcttagcacacctttttcaataatccacagattagcaaaaagatagaggatttaaatttcacaattgatgtgctttaactaatctctctagtatagacaactttgtacacaacagaaaatgacattcttttcaaatgcacttggttttaaaaagtgcccaggtattagaacatgcttattcaagagttaaatcccatcaatttcttttttnnnnaagtggaangngtactcntnggggtcnnntttattnttcataatttatttatttagcanatntttattgagtgcttactatgttccaggccctgtttcaggtactggaaatgtagcaaataagaagcaatgtctcagttcccaaggagcttacatcctagatagaagaatcaaataatacataagtaaatgaataagtgataagtcctgtaatgatttcacattgnatacctgtatcaaaacatttcatgtaccccataaatatatacatttactatgtacccacaaaattaaaaataaaaaaatttaaaaaaggaaagaaagtcaaactcaatgatgccatagaagctgcagggatatttttaattgcacaattaagaaataccttgaagagaaggtgacacaatataatgaaataaaattagacattaatgcagtccccacaccgaatccaaaatttaagaaaaaaaagcatcttctaaatgactctgggttaaagaaganataaaatcatgacttcaaattatgtagatgagatggaaataaaacccaccagatgtaaaacctggggtgagg

SEQ ID NO: 1070 - DNA, 763 bp, Homo sapiens
  misc_feature: Incyte ID No: 1074024.1
ggaagttgatctgagttgggacttggatgtgtggagtttggtctgcctttgagcattcagttggacatgtgaaatgggaagtggccagttgtatgagcctgatgttcataagagaggtctgggcttaagataggaatttgggagtcagcagagtctaggtgggaatgggaagcctggtgagacggtatacagagggagaggcaggaggcctgggcctgagaaccctccaggccttttctggctgggcagaggaggctgagtctgcagacgaaatagagcagagatgggtaagaaggcggtaggtatagatgaggaaaatatgtggttaatgatagcccgaagtcgagaaaatttgagagtgaggtcagtaaggtgaaatgctacatgtagaggtcaagtgaggtaaagtactggaaaaatgcccatcagatttagagacatgtggtgtcattggtggccttagctatgagctgttttggtggcatgatggaggtgataagccagactggcgtgggaggtgaggataactagtcggtgatacatagagaactctttgcccgaaggttggctgtgggaggagggtatatgtggatgtttaaagtattttgttttttctttttgtttaaggtagtaaagagacttgaacattgtttaaatgtcattcggggtagggagccacgttcaaggagaggtttggtaatgcagtgacgaagaaacggacagtgtttcattttttcaacaaatgttgagtgcatgccactca

SEQ ID NO: 1071 - DNA, 1373 bp, Homo sapiens
  misc_feature: Incyte ID No: 233218.7
agagctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccata

SEQ ID NO: 1072 - DNA, 1334 bp, Homo sapiens
  misc_feature: Incyte ID No: 1092387.12
cctgttcattggagagatagatattcaatgttattcatcaaacctactaaattatgctagacattacaaaatttgcctctagattcttgtgggtcttctaggtacatgaccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttaagtattgtctctgcaccctactgtctgatgaacttggttgttcccaattggcaatgatgtaatctaaaaataattaaagttttctattactttgataggtgtttgaattccagttgacttcagaggagatgaaagccatagatggcctaaacagaaatgtgcgatatttgacccttgatatgtaagtaattttggagatggttgtcctaatttattttcagaggaggaacgtaggatgggtgttgagagtgacctccacgccaggggcacagaggccaatgtgagacagaggtgagacaggagctttctggaagtctcctcctggattcactccagagctctgttctctggcagggagagtggccctgggtcagcatgggtcaacctgtgcctctgctctcgtgactccaaggaactttccagagcagccaagatcattgctgaatctgcaccttccatgtaggcctgccgtttgtattactgtctagtgtacacactgtggatatggcccatgtggtcgcattagatgtttccaaatctgcgcttctatcttgttcttcccaacctgctcaatgtcttaccagatcaaaggcagttccgtcaatcttgtgggccaggttccaattcccacctctttcacatggaattgcttgctggatcctgtcaatttagcatttttaatcatttcaaacctttttcgtgcctttctttgcatgtttgcccatgagccaaatactgcatttgcctccagaaagtctgtcttagtggagcgaataggagcacttggccttggtgttctgcaatatggagatctcagtgtagagaatgaggaagtgttaaaatcaaatgcagagtgtagatgcaaaagcaccattattggagataatttataaccattttgctggcccccctaattatccattttctgatgaatattaacatggagggcattgcatgaggtctgccagaaggccctgcgtgtggatggtgacacagaggatggcatcataatgacatggtgactggaac

SEQ ID NO: 1073 - DNA, 1636 bp, Homo sapiens
  misc_feature: Incyte ID No: 1092387.11
ttaccagatcaaaggcagttccgtcaatcttgtgggccaggttccaattcccacctctttcacatggaattgcttgctggatcctgtcaatttagcatttttaatcatttcaaacctttttcgtgcctgtctttgcatgtttgcccatgagccaaacactgcatttgcctccagaaagtctgtcttagtggagcgaataggagcacttggccttggtgttctgcaatatggagatctcagtgcagagaatgaagaaatgttaaaatcaaatgcagagtgtagatgcaaaagcaccattgttggagataatttataaccaataacagaagtttactattcctctgtgttctaaggttctaggattcatagaaggtcattcatataatgagggaaaaaagaagttatgtaactgctggcagtagggatttcaacaagtaatagagatgatgagataatgtgtgaaaaaaacaagcacaatggtacatcataagtacccaaaatttggtggatattattagtagtattttattcatttagaggaaaatacaaaatgaaaacggagatgataaaaagaaaaggaaaagtggcaagcattagaaagttttaaaaccaattaatgtttttggggatcatgaaatcaatcactagtgttattttgtagaactcaaatatggtctggagtaaaccacttgcgagcttccaagtgtttgctcttggtgtaatcaaaaaggataggctcaattccctaattaataagttgtaattgtacatgtgagcagtcatttatctgtgtctttacattttgtgttatttctgcctataaaatggtttatacattgtagctctttggatattggaccctatatcaaaaacaacaatttacttttctgaatctaaccaactatgttgcatatgataggcaggtagtaatatgtaaagtaattaagtataattgctaccagtataatcatcacactcaaaattgtttattagtgatgagcatatgtcttgcttattcctcttcaatgtaaggcagtatagttccatttttactgagaatttgaaatagaaaaggtcaggatatctctttgctctgttgacagatgtagagaaatatgtttgaacatttcactttgtgtgttttatgtgttaagttccaggcaggggaatagaattaaattattctttattttgaaaatacagatatgataaagtcacattcattaaacaaagaaacacagattctagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacct

SEQ ID NO: 1074 - DNA, 563 bp, Homo sapiens
  misc_feature: Incyte ID No: 366463.1
aatattgaagtaataacaacaatgtatttaattatgtatgcttatgtatatatgcttatgtctatatgatatatatgcttatgttatacttatatataagggaaatgaataataatgatacaaatgacaaggtggaagaattaagattattttattataaggtactcatactatctacgaagttgtatagtgttatgtgaaagtggacttacattagttatacatttaaaaaactgcaaattctagggaaaccactaaatttttttaaaaaagtaagtataactgatatgctaagaaaggagagaaaatggaatcttataaagtgctcatttaaaaccacaaagggtagaaaagagtggaagacaaaaataggaacaaagaacaaaggcaataaatagaaaatggtaacaaatatggcagatactaatccagctatataaatcatcactttaaatgttaatggtctgtgtccttggcctgggtagagtggcacctagttggtggtgcccatattagccagggacaaagcaaccctttgttcatcccagcttggcttttgatct

SEQ ID NO: 1075 - DNA, 381 bp, Homo sapiens
  misc_feature: Incyte ID No: 304409.1
gctcgaggtgatacagaaactacaatgaatgttattaaatgaaacttgtttcttgtgaatgtttataagtcattaaaaacacatgttcttgcttcccacagagtttctttagagggtactagttgtgcacatgtttagttctgtgggagcaacatttatagtactgggatgagagtgttgtgcaaatgaatcaacatcacttcctttagtaaagtggaaactcctttttcatttttcttttttcctcccctttggacaaaattttagcataaggctatatcctggtgtcttttttccccttttatataataagggcaaagagatagggtattacttttatgtcactcgcttttatctaaaaataaaaaattctcagccgat

SEQ ID NO: 1076 - DNA, 924 bp, Homo sapiens
  misc_feature: Incyte ID No: 1382920.38
atctagaactaccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgcctcctttccttagtcgccgccatgacgaccgcgtccacctgcgcaggtgccgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgactttcctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 1077 - DNA, 927 bp, Homo sapiens
  misc_feature: Incyte ID No: 342365.1
agatgttgtgatctgggtacatactgacatgtgtctgcatggggacacaggcatatactaaagaagaggcaccaagagaaacgccgattaaaaggggacaggttggtatcatccctactctgcagataatgatagcgaccattttttgaacactgttgtgccaggcactgtgctaagcactttacagacactatctcactcagtcctcccgacaaccctatgaggtgtcattaatattggactgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggactacatactagtattttgctgcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagatagtccttgtaaagaaaataaaataaagaagcggaaaggtgagcacttt

SEQ ID NO: 1078 - DNA, 568 bp, Homo sapiens
  misc_feature: Incyte ID No: 399210.1
atctcagctagtaaaataaaggggaagggaaggaaattcaggtctttagctatgcattcataaactggacttaagaagagccttcctcctcttataatgctaactgctcttaatatttccttcttaatgaacagttgatataagagttttctcctttcatctaagaaatacagaacaatctgcaagttttcttagttgtttgttaaatggacttcgaaatgattgagaaattcgtatttctcagcgaaaataagtattaagttaatggacaagtagcagtccttgttgccaccaagattttgcatctgaattgtatatataaactgtgtcaggaatatcataaaatcatgttgaggctgcagggacaaggaaatttcatctcatgaatctgtttgatgttttcgggatgtcctgagagaaaaattctttgacctgcctagtgagcaaggtctaagtttgtacacccaggtcacattgtaccctgggctttccaaagatttatcctgcatctgagccaaaggcttttgaagcctgtggttgctggaattttagggtgtatctctttgct

SEQ ID NO: 1079 - DNA, 1199 bp, Homo sapiens
  misc_feature: Incyte ID No: 1089210.1
aaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtggaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaactttaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagagggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagt

SEQ ID NO: 1080 - DNA, 959 bp, Homo sapiens
  misc_feature: Incyte ID No: 444619.9
  unsure 698: a, t, c, g, or other
cgtgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcaactggcttttcccttctaacaagtgtctcctgcaactgcggcaanttcctgcaaatgcaaagagtgcaaatgcacctcctgcaagaagagctgctgctcctgctgccccatgagctgtgccaagtgtgcccagggctgcatctgcaaaggggcatcagagaagtgcagctgctgtgcctgatgtccggacagccctgctcgaagatatagaaagagtgacctgcacaaacttggaattttttttccatacaaccctgccccatctactgtattttttttaatgaaatatgtgaatgataatagtca

SEQ ID NO: 1081 - DNA, 431 bp, Homo sapiens
  misc_feature: Incyte ID No: 312986.1
atacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttggtcaaatatg

SEQ ID NO: 1082 - DNA, 4591 bp, Homo sapiens
  misc_feature: Incyte ID No: 462057.1
ctgagtcttccgtgtgtcgccgccgttgccgcctcagcttcagcctcgttactcctgcggttctgtggctgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaaaa

SEQ ID NO: 1083 - DNA, 3531 bp, Homo sapiens
  misc_feature: Incyte ID No: 197902.12
catgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaaggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaggacagtaccttcta

SEQ ID NO: 1084 - DNA, 3049 bp, Homo sapiens
  misc_feature: Incyte ID No: 997394.4
aaacgtgaggccctgagagaggtagtaacttgtcacaggctccaaacacaggcctgtcagagctggactccccaccctgagctggggacccccaagtgctcagatgaacctgtgtggcctcatgcccatcttccccgctcccctcgaccaggtggctgacatggaggagctgaccatctgggaacagcacacggccacactgtccaaggacccccaccggggctttggcattgcgatctctggaggccgagaccggcccggtggatccatggttgtatctgacgtggtacctggagggccggcggagggcaggctacagacaggcgaccacattgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagcggaagcaggacattttctggaaaatggtgcagtcccgcgtgggtgactccttctacatccgcactcactttgagctggagcccagtccgccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtctgcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacaaaa

SEQ ID NO: 1085 - DNA, 1797 bp, Homo sapiens
  misc_feature: Incyte ID No: 2481150CB1
gaggcaagacttcggcacgaggcaggactctgggaccgcaggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaatatc

SEQ ID NO: 1086 - protein, 266 aa, Homo sapiens
  misc_feature: Incyte ID No: 2481150CD1
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 1087 - DNA, 1672 bp, Homo sapiens
  misc_feature: Incyte ID No: 008198.1
gggcaacgctgacttccgtaatataggttctacctaaccatctctaacactgctgtcaaggaggaccagtgttaaggtactttactaacaaccacacaaatttttaaaagaaaagaacactcttagcagcctacggtactttgaaatgaaatattgcctctcattctcacttgtgttgccattccaaaagtttgaatttgctgaggtttatattctgggtattatataaccattggttctatttggcataaccctattaaatggtgctcagagctgaattacctacagaaactttctggtttaattagcataaattggtataaatattagtgagcccatacttctgtgatataattaaaccaacttaatgattctcacataaggtgtcaatttattttactaatgcattcataatctatgcttgtagcaacatttttcaaatgtttaaaatgctaaatcttctcaattttccaatcttttcttgaatctattagatacctatagtgtagttactgaatagctgggaaacaaatacacctagttagaaatggcactgctttataaaaggcactagagaaaagacgagactattcctatatttaaatgctgctggcaagtgaattccttgtatataaatgaaagataccattcattaaaatgaaagacttgttttaagtgtgattcttacatttcattcatttatgatagagtaaatggctttataattactttaaaatttaactcactagtacattaaatctgttcattgcaagattagaatcaactgtgaggggaactaatttaaacaagcccttccttagtcttattgagtctcatatttgctgaaagtacctacagcttgcaggataagggagttcacggaccatagggtgagtgaacccatgcacaaattgcaaactgcccagagctactacatttaggatttttagacctttaattttccatgtcatagaaatttgttacaggttcatcacatctttgtctaaatggcaactgaatttctttaaagataggttaaaaaaaggcataaaactatgaattattatccatttgtgtgcctctatttttgctttagaatcatggaaatggaccctgtgaatttgggaaacactgttatgtatacacatgggtgaaaaacaatctaacattgtgtaaattaaaatactttttttgaagttgaaaaacatccatttgttctaaatctatatatattatgtgtatctagtacagaataaggtgtaacttctcattgagtaatcttaggttttacagatatgtaaagctgaagcaactctaaagagtagacacttcagaacaggaaggttctggtcaatgttgagagtagacactttcactgaaggttctggtgaaatgtgggtaactaattgcttgtaatctataatttgctgtatacttaactattaagttaaaatgtcatttaccatgctttttacactaaaagctttaacttttctgagaaaataatattttaaatgttcaattattacttctgaggaaagctacttctagcattctttgtcatgatgtgcttgtgtgcagtaagcagagcattttcagccacttacctctacaatgttcctgtttttcaatttctgatttagattataaaaggcaaatgattaatttaaaa

SEQ ID NO: 1088 - DNA, 1278 bp, Homo sapiens
  misc_feature: Incyte ID No: 072297.2
cctcctcacaaactggctatgtgatcatgaacaaattaaccggccagctccaatttgcttcttaatgttgtgaagtgtaaatgaggccatgactggcaggtggtacctggaaaaaggtgcttgtttttactaaaaagctgtctgaactttcaaattaaggcagagttcaaaataagtgatagttacttagtggaaaatgaaacctatccaacatacagtttgaggttaccttctagagatgtggcattgagacaatgttggaacattatatacaggcttctgggtgaagaggtggctttgactgaggacggtatgcgattttccagctcttttcctaaatagacccttaagcatccaaacacatgattccgcttttaaccactgacccaaattttaagatgactgtggtaggctagggtgcagcctcagaactgagtggcttatccaggattaaagttgacctcattaggacttaattccatctaagtctaagtcagctggctgtggaccgtaatctaacaagggctccgaaacaattcaaaaaattcaaaaagggtgtgaaaatttaatgactggaccatcctattgatttgcaaaacctaatattcagctctaaaatcttgagtgtgaagattgagtgttccaccataaaaatagaagagaatttgtgttaagctatacccttcacactttttgttcacttgtaagaaactatgtgattattttcattcctgggaaaacctcccaccgctgtctccagttgtgtacgtgggtgtgtatgaaatccgccccaggcccctcgtcaccccacagtatttctttacgatcctcattctactgttagaaatccagaggaatgtgaggaggaaagcaagtataaacttcatcataattataacaagttgttaaaaaggttgtgttcatttcagaaaatgtcttcatgaggtctggtggtctttttccctgacaatttgtatctggtgttttgtaaagcattaccattttatatgaagttaaagcagttactttgaaaaagttacatggggtaagtataaaattggaaaggatatttttgtagttttaagaagagtaagacttctccgcgtgaaaaagtgttttcttgtgaattagctgaagctaccctgtattttaatagttaggctcagaggtgacacatgctgtgctttttcttcttgaaggcaggttgggagaaggtaagacaagtagttgttatttttaaagagctgggaaagctgcgtatcatgcaattgaggaggg

SEQ ID NO: 1089 - DNA, 273 bp, Homo sapiens
  misc_feature: Incyte ID No: 994430.16
ggggtgggcctgtcctggggcattggtggcattctgggggcatatctcttgctgtgccttctctgcctccccctggtaagagctctgtcttccttttcctataggaaaagaaagcaaacaatgagaaacagaaagctgaaagggagctagaggtgagtggagggtgtgaagtttcctcctgtcctccggagaatgtttctttccttctatttcagcacttgcttggcttttctcccaaagggtcaaatccagagattgaacatagagaaaaag

SEQ ID NO: 1090 - DNA, 1261 bp, Homo sapiens
  misc_feature: Incyte ID No: 189036.1
  unsure 944: a, t, c, g, or other
tccatactctgtatcatataaagcagaaggtgtttaagagcttgctagccgtcatttaaatccatgactcaagacgaccaacactgggttaccaataatcttcagaaagtaccacctactcaccgagtgtaacatttcttgtagttagcgacctctgcttaggaaatcaccagctcctggcaatgaatccatacttccaagaactcacacattcaggcaaatatatggacatacagctctaaatatagatacagagaggtctgccgtgacagttcagtaggagactggaaatacttttgctttctgtatcgatagtactttctttcctttttaaagagaaggtttcgttttgatcttgagaaattctgataaaaccaccaactgaaaacctgccattataaaggagggatttcacaacgttcattccaaaaaactgtggctattcatttctggaagtgattcactgcagaagaatcgctgtttgggggtggagggagcgttgatttttagaagccagcctgccctctgagaagtgagcagcaacctctgagatggcagccacgtgccttttgacccccagccctgctccctgaatcaccacccctcgagatgacacgcagtgaccaatttcctcttaaaactccccttcttttcaaaaacccctatgatccatgcacccctctgtctaatcctctgcgatggggccagtctgcagatccgtctgggcgggctgcggtagcattctccacctgccaacactcagttgctggtgagtaaccagcatacggactctcacttcctaggcagggtctcacttcatctcagcctccagagtagctgaaactacaggtcacccaggcatggaatgcacagctctgccagacagaaagcgctttggatgcctgagaaacaacagcttgtccgggctactgatgcgaagaggncatggtttcctttttctctgctctgaatggcagccttgacgtcacaacagctaggaaccactggagggacaaataacaaggcgcaagccagaagcgccctgctctgtcgcaggggcagggccattttcatccagttctgatgtcttctgtggccgctgcgagtcggcgggagtagagacaaatgactggagctttaggcgtaaaggcggtctctctctaggctgatcaaacagccctttgcccagtgctaattgccttcacggaactggataaactacagttcccgaattaaacttgtttctgatgaactagacttc

SEQ ID NO: 1091 - DNA, 2030 bp, Homo sapiens
  misc_feature: Incyte ID No: 221042.1
gcctgaaatggggcggtggcaccgagagggaaggcggctgctgggcacgcagccggaggcgattgagggcgaataattcccagcccggctccccgggagacgggctgcggggcgggcacctggctgggtggggagaggggcggtacgcaccacgggggaagccaatgagaaaatcaggcccagccctagggggcggtgctgtcggtcacatgcgcacctggggcgggtggtggcggcggcgcgggcaccgcgagccggcggaagggagaggggccggcctggggcggggttaggcaggtgagtgacaggctccagggggccggcccctgcctggtgccccgagcgagccgggagtagctgcggcggtgcccgccccctctctccgcccctccagcggagctggtctccggccgggcaccgtcgcgggcccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacggctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctccttcaaaaaaa

SEQ ID NO: 1092 - DNA, 921 bp, Homo sapiens
  misc_feature: Incyte ID No: 408398.1
  unsure 587, 589: a, t, c, g, or other
gtccctgctgggttcaatgttcacacttgggtagaagctgcaggtccctactgggttcattgtccacacttgggtagaagctgcaggttgctgcagaagttgcagtgcttcccttgcgcttttttgctggtgaccacaggacatgcccagagtggaggccctgccttttgctttgtgagcttggagtgttcgtgccttctgcataggtgggtgggaacagtgccaaatactgatcctgaatggcctggggtctctgtgtggacttgtcgggcagggaggaaggaggacggtgtctctgatggcagggaacagttctacaggtgctgctgtccaggcatgaggcctggacatagagctgggccctgctctatgtgacctgaggacagaagcccttgtgagtggcagagttgtggtggtgaccacgcagactgctgtgtttcccgtgcacttgcttttttccctcacttccaacctcccatccaccttgtctgccctctggagcctgtcgcctttcttccttgtccacacctcttctacccagcagcccagccttcctgcagagcagctgggcagtgcccacccccacncnacgcccatttccactcctggcactatttttcctggaactgtctgttccacactgtcctatgcctgggcctccccgagcgtcctgtgagatgccagttggcgagagtctttgctcggggtcctgaagcccccccctcgccccccttcttgatgttctccaccaggattctcctgtgccagatcccatctgcagggcactggccccgcttctttgaggcctggactgcaaatcctccttccaaagaggccctcgagcctcttcgaagcttactgccagccgtcctgcagttttctttctcctggcccctgatgacgctgaatcccagccgtctg

SEQ ID NO: 1093 - DNA, 1344 bp, Homo sapiens
  misc_feature: Incyte ID No: 985369.1
ggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagaccttgtctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaac

SEQ ID NO: 1094 - DNA, 450 bp, Homo sapiens
  misc_feature: Incyte ID No: 328796.1
  unsure 120: a, t, c, g, or other
ctggattgcttcagattcctggagtagctggactgaaggcagagatgaggggcttgttgacctgggagctctttatagctaatgctgctcggcttcagttcctgaggcctgccgccgtanggcctgcctgcaaacgcactgtcaccaccccccgccgctgcagccccccaggagttacgcttttgcagaagacccagctgcctaagtaaaattaaacaccctcaagctgtttgaggctcttaaaaacattttctcagcactgaacttctctgaagatctgagactattagcacaaaaccaagagttctctctaaactgcttttctctttcccctgaatgcaaatgaacttcccctgctggtttccattcatctgacaggtcataattgtgacgttggtaaaatagagaaagttcccttttgaaaattgagctatgagaactttttttgtt

SEQ ID NO: 1095 - DNA, 715 bp, Homo sapiens
  misc_feature: Incyte ID No: 058804.1
cttggtttagtctgcctggaaatgcctcctgcatcagtcctttggtgtgctgagctgacattctccaaccatgttgcctaataaagcccctccagcttctgactattgcaatgtgcatcatgtttctccttagttgtttgcattgtctacaaaataaaattcagcctgaaagatccacatttcaggcactctgacctcttagccccaccgacgtttccagcttttttgcacaactttcctacacatgtagtactgtggatcagtcatatcccacagtttatgcctgtcctgcaagcagaaagcaggatgacttagttatagtatttgtcaacttgagcaacaaacagatcatctataaaggaaacagattatcataaatatccacactgaatttgagttaaataaagacaaagaaaaaactaagtatgaacttcttcatggatctgatagactgaatatgacttctttttcttgatcagtagagaataaaatgattctttctaaaaaaagtctttgaaatatttgagaaaatcaatcatatattaagtctttcccttattagggtagtagttcttgtttcttcagctgttacaagaaatggtttaaaattctctcttccaatcagatcacttctcaggtgagatccagttggttaatgtctctcttaaagtttaaacaatacagcacacagactcatcattctcttgatgtggat

SEQ ID NO: 1096 - DNA, 1054 bp, Homo sapiens
  misc_feature: Incyte ID No: 3505463CB1
cgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatgctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggcccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgtaaaaaaaaaaaaaa

SEQ ID NO: 1097 - protein, 213 aa, Homo sapiens
  misc_feature: Incyte ID No: 3505463CD1
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTMLNKIDSGELDPERMGSGIQYGDASLRQLRQPRSAQAVAPQPCGC

SEQ ID NO: 1098 - DNA, 3698 bp, Homo sapiens
  misc_feature: Incyte ID No: 197159.1
ctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaaccatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatctttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaaaaaaaacaaaggg

SEQ ID NO: 1099 - DNA, 875 bp, Homo sapiens
  misc_feature: Incyte ID No: 369928.1
  unsure 47: a, t, c, g, or other
atctgatgtagcagcatgacctcaagcgggttcctttacatctgagncttaggtttcctcgtctgcaggggaggtacccagattggaaatcatgagagtccaagccccttaaattgctaaaggaatactagctgccaaaaacagatgacaaaagtattgaggaaagaggacttgctagaagtgtctttgcatttcttagaggatccaaatcccaaggttggacctaactgaggccaccatttactgagagtgcaagcatcaaacctgttgcatctctggacatcatttatttctctatcaaagaactgttgcaagaatggttgcctcccaccttttccacacaaggatgtgagtcggtgttgttttcttgttgggtgctggactcactgtaccaggggtatggtggcatttccagggctggaagccctctatgaaaaaccagcaccccaccctggccaagttggaggtcctgctgtcctccagaaatgctggcagccacaagctgcagctgtgttgcaacaagtctgatttaatttggggggtggtacagagatagcactgtgatgttttttaaaagccagaagaatacagcttattcaccaaactgtgaaactggctatgccttgggtgggggaagccagaggaaaatgtgtgatagcgttttttaaaagagtaaaaatggtgataattataaatttactataatgcccattattgcatgagatctaagtggattaactcattatagctaagtcagcatcaggttttcttaaggcctcttcccttctggggtttataattctgttcttatctttctattaatttataaggtgggaagccaatcattgtcttttgtaatccttgttatcacccca

SEQ ID NO: 1100 - DNA, 1987 bp, Homo sapiens
  misc_feature: Incyte ID No: 413466.6
  unsure 806: a, t, c, g, or other
ttggctagcatttttgttaacagatactcggagaaacaagagaagtatgtcaacaactttacttctccctcctgagtattgcaagtttacacataagctctgaaactttgcctcaaaagagggagtggggttgtgtgggtgtgggtctttcaggagggggacctggagagctggagagaggaaagaagtgcagaagactacagggagctcaccctgcatttttctctacttgtaatcagcatttgcttgggttggggaatgaatttgggagagtcttatcccagtgttctgaaataagtctcttttctgcagatttctttctccaggaagaaaaatggcatccgttgcagttgatccacaaccggtatgaattttgagtagcctttgtctactttctctccttttgtgttttgagagattaataagcataccctccctactttgattgcagagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggatgtagccaatgccaaaggtgctgagacttggggcaaaagatgctgtgacgactactgtgactggggccaaggantcatcacagggttgatggacaagaccaaaggggtagtgactggcactgtggagaagacccaagtctgtgtcagtggcagcattaacacaagcttaggaagtcagataatgcagctcatgagcagaggcttggaacatgcgctcaccagatcagagctcttggtaggacagtacctccctctcactggggaagaactagataaagatgcggaacaagttgaaggatatgatatggttcagaagccaagttgttatgttagactgggatccctgtctaccaagcttcactccctgtccaccaagcttcacttcgtatgagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtgtttgatttcaccaccatagacttgacatctgagactgatgaaattccagatattatagctttggaagaggagaacggatcaaataattcacatgctaatggccctgtcctctcagggcaagatgttgaataactaacaacaataaaataccccttttggttgaatacgcaatttgtattacattaaacttcctgtttttattcctgtgactttgaagagtgttaatctattttttggctacattggtcttaattgcaatgacactctgatctaaacttttgtaagagatcctagttctgtgtcatataatcatttaatataattaaagtttaattgctgaaatacttataatgaaa

SEQ ID NO: 1101 - DNA, 720 bp, Homo sapiens
  misc_feature: Incyte ID No: 397295.1
  unsure 378, 436: a, t, c, g, or other
aagtgtggtggtgactctcatacctcaaaccagccaataggagagatcctgtttcttatagctaggcttaaaatcatgagtatggtcatgggtcttcttgtacgaaggtcctagagaaataccactttcttttatactatataaatctcttactgtacagagattgccattccagcgttcagaacacaggtgagattgtgtttctcatatgcataccccagcaaacattaaaattgtcatcttcacacatggacagggtccactggtaagtcctgaatctcacacatggaaaaaatccacagttgaaattgtgactgtcatatatgaacatccggccagagttgaaatcatgagtcatttctaaattcagtttatagncaagtgagaatttttctatctgaacctgagagaataaaaggtggttttgaattagacnaaatagagctaaaagttcaaacaaatggtggaaggattgtaaaaatcttgcaaagaattccatgtgtggttatattgactaaattcaaaaaggtactacatggtttttctgtaaataaaaaattgaaataaaagcacaacaaggtactcgtaatgcactaatctgctttttagcaaactttgttaacggttataacagattgttgcttctttaaaattttggagtcattgtaaccaaataaataatttaggataatctgaaattctaaaatgaaatacatgaac

SEQ ID NO: 1102 - DNA, 1127 bp, Homo sapiens
  misc_feature: Incyte ID No: 1330139.5
gggggaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatttaaaaaaaaaaaaaagggcgccgctctagacttgag

SEQ ID NO: 1103 - DNA, 2797 bp, Homo sapiens
  misc_feature: Incyte ID No: 977951.1
cctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggcagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatagtgctgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaagg

SEQ ID NO: 1104 - DNA, 5106 bp, Homo sapiens
  misc_feature: Incyte ID No: 347316.1
ggatagagacaacagtatgggaattcaacgagacgtttttactttctttgaccaagattcaaattctttattccaggccttggatagtaaataaggaaggtaattcgtatgcaagaagctacacgtaattaaatgtgcaggatgaaaagatggcacaggcactgttggtacccccaggacctgaaagcttccgcctttttactagagaatctcttgctgctatcgataaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctggggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaacgaggagagactcactgtttgagccgcacagacatggagagcgacgcaacagtaacggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgccggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgc

SEQ ID NO: 1105 - DNA, 1247 bp, Homo sapiens
  misc_feature: Incyte ID No: 150288.3
gagggaagctaggtatgtggggaggctatatagaaatatatatagaatatcatgggtagaaaagcatccattttttatatagcttcttgaatgttagagtaatttacataaaagaatagtcagttcactcttcactttaacactggtttctaaacaacaacctgtttatcagtcatgatctgatgaagttttcacaggtttgtagtaacataagaaaaaataagggcaaggtagcacgtttctgataaaattaatttcattcagtatcaagtccatcattttgagataatgccttttacactttttttagtattaaaatattctttattttacataatgatatttaaagtagtattcattctcttattggtgctaacttgacataacaagctagcaaaccatatagtggtccccacaaatttttggcccctgacatctaaatgtctggaagtactgatctgttctcttagtatgttttagttatgtaaagaaaatagaactacatagaagtagaagtaatgagactatacctagggctctcaggagagacacttaattgtggctaatttttagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatgaaaggattcctgagccatcttttaaaaatttttttatttttaacaatggtaatatgcaaataacataactgaataatctttttgaatggaagttcttgatctcgatactaagcagattttccttagcatgtctacaggaatttagtgtcaggtcagagttatggtttcaaaaaattaggatttctgtaaacaaaggcctgcacttaaaccttaaaatttattgactgacatgagtggtataactagtgtatatatcaagagttaacatttttaaattggtgtgcaagaagcctgattcaaagtagctcacatggtaacatttattgtaatactttgagatatttagtaataaatattacaaatgtataagtcttctaagacccaaaatgtataccttaagaaacatttt

SEQ ID NO: 1106 - DNA, 1274 bp, Homo sapiens
  misc_feature: Incyte ID No: 002455.1
gcggccgccagcttgcaaagccgaagtctggccgcgctcttcgactcgctgcgccacgtccccgggggtgccgagccggcggggggtgagtggtctgcgccggcggccgcgctaggaggtgcgggcacttgggggcgccgggaaggggaacttggcagccccgcgggggccacgggcgatcccaggggccaggaaggtcccgctgcgggcacgcaatctgcctccgtccttcttcacggagccgtcccgggcaggcggcggcgggtgtggcccgtcggggccggacgtgagcttgggcgacctggagaagggcgcggaggccgtggagttctttgagctgctggggcccgactacggcgccggcacggaggcggcagtcttgcttgccgccgagcctctcgacgtgttccccgccggagcctccgtactgcggggacccccggagctggagcccggcctctttgagccgccgccggcagtggtgggaaacctactgtaccccgagccctggagcgtcccgggctgctccccgaccaaaaagagccccctgactgccccccgcggcggcttgaccttgaacgagcccttgagccccctgtaccccgccgctgcggattctcccggcggggaggacgggcggggccatttggcctctttcgcccccttctttccagactgcgccctgcccccgacgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgtgggtttctcctaaatctgaagaacgatgggaaaatgcacgtggagatgaaaccagatttttaaaaattcaattaataaaagcaacttcagaaaaaagagatgaagacgagttggggattgtttaatcacaacctcaagtgttaaaacaaaaacaaacaaacacgtttgtaggttcttactggaccagaggagtcaagaaaccaagatggtttggggtatggggtggggacggcaaaaggggtaagagctggcttctgtagccacctgtcccttctatttttcagcgaaggtcagtgtatttagtgtaattaccccttctaaacagtgtcctagtccctcccttccctctccttgagtgcattttgaattaaagcctatattgaaaaaaaaaaaaaagg

SEQ ID NO: 1107 - DNA, 792 bp, Homo sapiens
  misc_feature: Incyte ID No: 372647.1
accacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctatattacacaatgagataagtgcttcaataacaatatagagctgtaagggagtgaattgaagagatactcccctattcttaaatgttcagtgaaattcctttgtcccaaagcgctagttaaacgaagc

SEQ ID NO: 1108 - DNA, 1147 bp, Homo sapiens
  misc_feature: Incyte ID No: 137710.1
  unsure 693, 713: a, t, c, g, or other
aaaaaaagcaaataaaagtaaaaggagaaatcaataaaacagaaaaatggtagagaaaattaacaaagctaaaacttctaagaaaagatcaacaaacttgaaataaatttcagtttgtactactacatgagactggacagttttcattactactatgaggctactcttgaaagtaacagttcctagaagatttttattatctcagaatgaccagtgaacttatgggaccaaccagaggtttcatccaggagacagagggaaaaatatagttcctgaaatagatttaaatatggagaaatagggcagaaattcaagttgctttctgctgttttctgcttccaaccctgggagtttggagagctgtctaggagtgagtcaatgtgctcctgtcttcccatcccatcctgctcgcatgctcattgccgtctcctatttccttgcaattcctctcagcagatatttcaagtagtggatcttaaccaaagatgggcatcagaaccctctggagtgtcactcaaaatgcacataaccaggcctaccccaggctttctgaaacaatttctagagtggggcctactcatgagtattctgacagatccacaggtaactatgtaatacatctctggttaacaaccacattaaattaaaaaaaactgtttttatggataattacaacaataaaaatagtgatancatttgttgtttcctttatnccaggcacccttttaggtgctttacatggatcaactcattaatttctgaaaattcagttttatcattagccccattctacaacaggtagagaggccaaccaatgtgtacacagtgatagctagtgagggaagcggccagaattccagcccaggctatgtggctccacagtccatgctcttagccacttgtatgtggatgaataacaaagctccttcctctgcccaggtccaaaacaatcagtgcaatatttattgaatgtcttccaccagtcccacactggaacaagtcagaacaagatgtaggctcttatgtctaggggttgtgtttgagactctaaagaaatgacccacgggcacttagctagattttttaaaagttaccatatgaaatgcatagctatattatttaaagttacaaatgtaaccaataaagg

SEQ ID NO: 1109 - DNA, 3611 bp, Homo sapiens
  misc_feature: Incyte ID No: 407644.1
  unsure 332, 345, 353, 3604: a, t, c, g, or other
ctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggnccccaggtcgccnccgccccnagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggaaaaaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgctgacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcacccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgagaaaaaaaaaanaaaaaaa

SEQ ID NO: 1110 - DNA, 1226 bp, Homo sapiens
  misc_feature: Incyte ID No: 373516.1
  unsure 1215: a, t, c, g, or other
tctggccctggtatgaggatctgagtctgtagatgtctgaggaggtgggatctggtacaggtgtgaggatctgggtccgttcatgtctgaggaggtaggatttggtacacatactagtttcttggtctgcccacatctgaggaggtaggacctggccctggtatgaggatctgggtctcttcatgtctgaggaggtaggatctggcatgagtatgaggatctggctctgtccatgtctggggaagtaggatttggcgcagatataagcatctgggtcttttaatgtctgcgaaggtaggctctggccttggtatgaggatctgggtctgtcaatatctgaggaggaatgaatctagtacaggtatgaggatctgggtctctccatgtctgagaaggttggctgtggtacaggtatgaggatctgggtctgtcagtgtctgaggaggtaggatttggtcctgttttgaggatctgggtctatccatgtctgaaatggtaggatctggcccattaggattttgaggatctgggtctgtcagtatctgaagaggtagtatctgggtgcgggtataaggatctgtatctgtcagtatctgaggaggtaggatctggccatggtatgaggatctgagtctgtcaatttctgaggaggtaggatctggtacaggtatgaggatcttggtctgtccatgtctgaggaggtagtatctggcacagatataaggatctgggtctgttcatgtctcaggaggtaggacggcgcaattatagggatctgggtctatcagtgtctgagaatgtaggatctggcccttgtatgaggatctgggtctttcagtatctgaggaggtaggatctggtacaggtatgaggatctgggtctctccatgtgtgagaaggtagaaatctggtacagatacaaggatctgggtctgttcatgtaggatcatgtctgaggaggtaggatttgatgcaggtattaggatctgggtctgtccatgtctgaggaggtgggatctggcacaaatagaaggatctggatctgtcaatgtctgagaaggtagtatctggccctggtatgatgatctgggtctttcagtatctgaggaggtaggaatctagtagaggtacgaggatcagggtctctctatgtctgtggaggtaggaatctgttacaggcatgaggatctgtgtctgtcagggttgtaggctcanctctgaaaaaa

SEQ ID NO: 1111 - DNA, 1938 bp, Homo sapiens
  misc_feature: Incyte ID No: 241762.23
  unsure 1317, 1343, 1373, 1755: a, t, c, g, or other
ggcgcatgtgctggcaagccggttcggccggccggcgcagcccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtcacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaaggtatgggggctcgtcccaggtcggggaggaacagtggtaagaaaaggtatgggggctcgtcccaggtcagggaggaacagtggtaagaaaaggtatgggggctcgtcccaggtcggggaacagtggtgagaaaaggtatgggggctcgtcccaggtcggggaggaacagtggtgagaaaaggtatgggggctcgtcccaggtcggggaacagtggtgagaaaangtatgggggctcgttccaggtcaggnaacagtggtgagaaaaggtatgggggctcntcccaggtcagggaacagtggtgagaaaaggtatgggggctcgtcccaggtcagggaacagtggtgagaaaaggtatgggggctcgtcccaggtcggggaggaacagtggtgagaaaaggtatgggggctcgtcccaggtcagggaggaacagtggtaagaaaaggtatgggggctcgtcccaggtcggggaacagtggtgagaaaaggtatgggggctcgttccaggtcagggtgctcctcggccacggcctgggggtaatggggcccacagttaggccctcctggccctcacctcacctgctccctgcagggctgcggacagcctggacacctgcccaattccacccaagcaggccaggccagagaatggggagtacggnccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaagggaacagaaaacacccaaaaag

SEQ ID NO: 1112 - DNA, 521 bp, Homo sapiens
  misc_feature: Incyte ID No: 1040914.1
gctgtgagtcgaagaaaagtgaaaatggtggaatttttattaaagaaaaaagcaaatgtaaatgccattgattatcttggcaggtacagaccttagttcttattgtgttgtttttaaacctgagtgtcattttagagtggtagcagtccctcaagtcataaatattacattagtaagaagactaacttttaattactgggatatagtgagaaatatcaacacagatcatcacttaggtagaaaaacaattatttggactgagtaacataaagaacagtgtatagcaggattcatctctctatatagacattatacacataaaaggcttctatatatagaaagctctgtatattgatagatgtttgttatttgtaagatgatgtggtgttatttacaatgtaataatgtgatgcttttgattgtatgatcttacattagctacaggggtttcatgttagtttttcatttctactgtgttttgatgttgtttttaattgatatggggagggggaaaaaagata

SEQ ID NO: 1113 - DNA, 1071 bp, Homo sapiens
  misc_feature: Incyte ID No: 358492.1
aatagaactctttttacttaaaaatctcaggatttttgggatctgagctcttgtcaaaattcactcaaatttcaccttttccaggacatgatctgcttatttagtcttttctctcccttctaaaatgtataccccataagggcagagatttttgttctcactggtctccagcatctggaacactgcttggcagatacttgatgccaaaaaatatatatattttttaattaattagtgaacaacacaattaccaagcacttaactacgaaccaacagttctacttcacaattcacaaatgattcagttcttaattattatttctgtaatttatgatgtatgaattttttaagtgttattaaatactagttgataagctggatatcacattaatcttgtagtttttcttctcacagtatggcagagggtcctattctcaaaggtgctattggcctgtactcccagcatagatcctccctgcatctttctagtgggctctgtgggggcttagtaattttctcgcgtaagacaggctatattgagacttgccttgtgactctcaacagctaaacacaagtaaaagaactttaggaaatcttgagttcagattttttataagatcttcacttctagtctgttcccatttggtaatattatggttgaactgaatttctccattgcccttgactctaaagttctggactttctgctcttgttttcctccattatggaaaaatgacaaatcattctgaaaagtctatatgtttcaggtcactgctttgtacccagataaaaatacaggataggtaagatgaaggctcacagtctcaaatcctcacaaagggcatggtaaattaatgaaggagtcggcgtagcaaatgtaagaattatattttttatttgtattgtactgtggtataagcatgtaacataaatatattggagatttaatttttctgatgttaaaattcaaatatccaattaaaaataggtattttgattatatttttcttctataaatatttttgccttgaaccagagaaatgtgacagtttctcctgccctatttggga

SEQ ID NO: 1114 - DNA, 472 bp, Homo sapiens
  misc_feature: Incyte ID No: 243924.12
gcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccatgacagagatgaacgggcgcatcgtgggcaccaagccactctacgtggcactggcccagcgcaaaagaggagcggaaggccatcttgaccaaccagtacatgcagcgcctctccaccatgcggacccctgagcaaagcccctcctgggctcctttcagcagccctccagctacttcctgcctgccatgcccca

SEQ ID NO: 1115 - DNA, 1554 bp, Homo sapiens
  misc_feature: Incyte ID No: 243924.13
gcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttcgcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccct

SEQ ID NO: 1116 - DNA, 1293 bp, Homo sapiens
  misc_feature: Incyte ID No: 208075.1
gaagttttactatgtttaataatttagtgaaatttgggctatgtgtttattgattcagctcaatccagaggaaaattttaaaggcttacagccttaggattataggatactatataatacttttggtacagagatagaattaaataacataaaaatcaaaaatttattaggctaaaattttgagggagaagtggtatgaaaatacaaattcaaggagtaaaaggaaaagtggggcattccttgctactaaaaattgccttgttccaggtaagactgatcataaaaaaatggccctgttcataaaatttttaaaaagatcatagtatctatcaaataacttatattaagaacctcctgggctaaatttaaaaagtaatacaacagttttatttaaacatgtagtgtctacggtatgccagcactttgcagctatttataatgagaaattttagatgtcaatatagcaatgtgcaagaagatagagattttcaaaattcacttaagagtatctgagcataaaatgttaagattgctgatcggatgtgagggctatctggctgcgacatctgtcaccccattgatcgccagggttgattcggctgatctggctggctacgtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagattgctgatctagggccactaagtgatgaagcaaaaaggatggctaaaaaggacctcaacccttttgactttaaaaggaaaatagcttaaccttcaacctgtgtgacatttaactttttgaacccaaccgtaaaagctatcttctaaccaacaaaaagttaataattacatttggaattatacagaattagaaaattggcatttaaaaatactcaataatttgtccctggtttttaattttcaaaatattttctttttgaagagccagattccagtgatcctgcctctcagaaatttccacatttcttatttttcattaggccttaagaagctgcatttgtaaacttgtgtttcattattaaagcttaatttattttttatataaatagtatgtgctttgtgtacatagagaattaagtgaatgagtcacacagatgttggctgttgttaatgtgaaaattaaacagctgtatcacattttgaaaaataaaagtttcatctgaatgaatataaaa

SEQ ID NO: 1117 - DNA, 712 bp, Homo sapiens
  misc_feature: Incyte ID No: 168955.1
  unsure 199-271: a, t, c, g, or other
aagaacatttaaaataggagtttcgtatataaactatgcctcaaagtcaacttgataaatatagtcactgataaaaaaatcaaataatagtaaccaattttaatttaaatacaaaatggatatggttgcagattctacattgcaactaacccttaagaaactatcatttgttgaattttagtatagtatcataaaaggnnnnnnnnnnnnnnnnnnnnnnnnnnnnnnnnnnnnnnnnnnnnnnnnnnnnnnnnnnnnnnnnnnnnnnnnngcactggggagaggaaaggaatggagagtgactttactgggtatttaggtatccaccttccaaaaaaatcataggttttcttcttgtggtaatgaaatgttctagaatttgatactggtgatgactgcacaaccaatattgaaaaccattgactagtaactacacttttactgagtgaattttatggtatgtgagttttatctcaataaaaaaaaattacacagaaaagctagatttttcgtatactttgaaataatgtgtcacaacagattgtatgcagaaatagatatgaaaatcctgctgtcttctagtacgctatgttagagatttgcaaatgtaaaacattgccattcttctactaaatgttttttgttatggcttaaaacaaatttggttactttttataaaagtgctatttctcttaaacacataatggtttct

SEQ ID NO: 1118 - DNA, 783 bp, Homo sapiens
  misc_feature: Incyte ID No: 428508.1
cctcaatccttttttgaaatttggtttgaggacagttctaaatttcttcctaacccctttctctcccataactttcatccctttatttctcccagccaggccttccatggtgtggaaatgatatggaaagtcaggttgccattttttgtaaggctccccacagtatcctggacaaattttctttctcctttccaaataagcgtcgatcattggactgaagtggatggttgagatgttgcagtgggaataaaaggaggtggcgagaacgttcttgcctaaaccattccccttcctttgttcccagcccaagggctgctggacagtgtctctcagagtacaccttggtccttttcctgagaaagacaaacttggaagtgactagcaggtctaattatgcctctatggaatccaaatgctggaaggagacaaagagaagtctggaggcctccgactggagagagagcatgatggattaaatccaagcttcgcacagtcccaaaaagctgtcagggtgcctgggcagcgtggagccgatctggacgatgcattccagatggcccgccttccttctttaggtttggggccagttggagctcccgggcggtctcccaaggtagccccccagagagctcggggcagctgtccagatgggaggaaccaaaataagaatcactgtggcaggcttggaattggaggaaagcccccaccccccaactttgtgttgaacatctggatctcatttctcacacttttcaaaacactcactctgctgtcgcaaataca

SEQ ID NO: 1119 - DNA, 1342 bp, Homo sapiens
  misc_feature: Incyte ID No: 418070.1
accagtgtgcattctagaaactccccctaggtagccacagtatggattgtgataggattgtctgagttgggctcatatttgggaggtcactgcagtcatcagagttttaagtcctaaagtggggcagaagagggaaggatgaaaaggagaggcagagtctagaactatttggaaggttaaatcagcaggatttggtaactaattagatgtgaaggcagtagaagtaacgattataactactaattaatgatcatagggctttcctgcataatcacatttttacccttgcaataccctaggtgtaggagtagtattacgtctatacaaatgaggaaacagaggcactgtgaggttaagaaaattgcccaaggtcatgtaacaaatatggtagaccctggcagactccaaatctgaacagctagccactgtgtgacacggtgagaagactcaaggatgatctctgggtttctccagggaaggctggtgtgtgtgtgatggtgtcaatagtgagttgcaaaatataggaagaaagaagatttagaaagaagatagtattcagctcagtataaccccatagtccagagcaatggttaaagtcagatagcacaagcaaattacacactttgctaaaagacgccccaataattaaatgttgtgcactgaggtgtggtagaaatcaagaaatggaaaaggctgagtatgaagcatgagactgtattcattgcttaaagtatattgttgacccttcctttttgaagatgactataattatctgctagatgataccaaataaattctcagcaattattagttgagttgccatccccatagaaactagcaagttctacaaaaggtaatatttctttagcttgctgctgttgggtttatctatccctgtccttctctgaatcttgttaataccacaaaggtttatatttaggaaatggtaataatccaaagacttgaaaagtttttaaagtgttgcctcggttaaggattcatgaaaatattgggtagcaacattatacagtgaaaaataaactaggcttaggatacaaacactaagtttgaatcctgacttgaacaattgttttatgacactgggcaagtgatccatagatctctctcagtctcactgtcttcatttgcaaacttaggccaatgataactcacagacggttgttgcaattattaaataaaataatgtatgtctcagtatttagcagagcattaggtacactgcagaagcttaatatattcaaatgtttttccttccaccctttatggacaaaagccatgtatgtcttttagtttatacgctaaaatgttgtgtgacagtaac

SEQ ID NO: 1120 - DNA, 744 bp, Homo sapiens
  misc_feature: Incyte ID No: 403994.5
gaccaagatcaggtcactgccctgcatgaattccccaatgacatcttcacaaacgaggatagaagacaaggtgcggtggtcctccatgtgctctgttttcaagacggaagtgaaaggactgtgggagtcaggacctcacatggaataaaccaggaaggcaggaggtgaagatgagaatggaatgcatgaatttgaagttgaggaaggccatatacatgttctatgcactggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggtggtgtcctgctatctgagttctttatgaatactggcgtctgttttggaaggtctggggaaggtgctcagaagccactgcgtgggaggctctgggcgacaagcctacactgcagcagcacctggagctctaacaaaccttggggccatccttggttgaccctatgccccatatcccatgtcaaagctaacaggaaatcctgtggatttaccttcaaaatacatccagatgcaaagttactgctagacgggaggaagaagctctggcattctgt

SEQ ID NO: 1121 - DNA, 743 bp, Homo sapiens
  misc_feature: Incyte ID No: 336726.1
ccgaggccagctgcccagagaaggagggctgggtggagaggaccgtgccagcagcagtaggcctgggccaggagacaggcacgcacctccgcggtctctggcgagtctatgtccacacagcggcaggacctccacccccagccacctgcagcagccccacatctccaccgggtcaccctgctgacatcaagagtgcctcccgcaatgtcccaacccatgagggcttcttggagctgaaccagggcaccggccacttctggaggggggctgctcgtgacttccgacctctgtctcgctagttggcatgagaagactggactccttctgcaggcctcagggcagaggcagatgtcagcccccagggatgtcactgccagaaccccagatgccccaagccatctggactcccccgtgtgcagtatctctgctacaataaaatgtacccagatctgagtcctctcaccctgggcgactgccaatgtcccctgcggccctattccccggcccccaggagcccagaggatctttctttttaaaagatattcagacctcacagataagtctgccctgaccagcccctccccagttcccaggccctatcctgacaacggccacaacttcagagcagctgaaacctgctgtgagtgaaaaatgagaagctgttgttttaattttactttctctgattactaatgaggttatttcttctctgcataaaaacttcattcgtgtttaaaaaaaaa

SEQ ID NO: 1122 - DNA, 1948 bp, Homo sapiens
  misc_feature: Incyte ID No: 337250.1
cgacagtggtaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtatggggggcatgatgccctggcttccaaccattgctccaggctttctgactgtgtggaacggtatgatccaaaaggtgattcatggtcaactgtggcacctctgagtgtacctacgagatgctgttgctgtgtgccctctatggagacaaactctacgtggttggaggatatagacggacatacttatttagaacacagtatgagtacatatagatagcacagagaaatagaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatccccaaagagctagacaattccttacatttaccaagaggaaagcttttactgtgttgaagctaaaaaaaataatggctctttgacaaaacttgttatgttgatcgcggtatgtcaaaatttttacaggtttgctcatctgccagagcacacatataaatttgggtatttcttaacatattatcttggttagatttggttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaaccacatgcttttctgttactgttatattatccagtagaaaatggttagggatatgtgtgctatataaaaaaaaaaaaagacttgattaagttattaaaataacaaaaaatggctagttgaaatagtattttatgtgtaaattcttccatttattctggtttaattatacaaactaagatgaaatattgaaaaaccctttagtgaaagtaacttttcaagtaaatgacaaacttaagaatttcctacaaataagttctatttaaacagtctttttattgtggattgtgaaaatcaaaatactggagaaatgcatataaaatatactactagcttttaagttttaagaaagaagaacgtaagttgtacaaagatatttgtactttgacaaactgaatttaaataaactttatttcctctcaaa

SEQ ID NO: 1123 - DNA, 1705 bp, Homo sapiens
  misc_feature: Incyte ID No: 410781.1
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgcctttttaatatcttttctgtgactgtgacacttcatgtgaatgacatacttcacaagtacactcgataccttgcctgctgacagctacccataatcctttttgagtcctgtttcagcgaaatctatgtgtttaagttcaattttgtagcacacaaataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaa

SEQ ID NO: 1124 - DNA, 1196 bp, Homo sapiens
  misc_feature: Incyte ID No: 347759.30
  unsure 1162: a, t, c, g, or other
acgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcagtgtggatcggcggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgctggggcctactgttatgtgagaacattaggccccagcaacangtcattgtgtaaggaaaaataaaagtgctgccgt

SEQ ID NO: 1125 - DNA, 1090 bp, Homo sapiens
  misc_feature: Incyte ID No: 1252060.4
aaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 1126 - DNA, 5193 bp, Homo sapiens
  misc_feature: Incyte ID No: 209279.1
aaaaaatatgtcactgacacataacaaatgagggcagaaatggcattgttcccatctggggaagagcctcaagggtgggcagtatacaaaacatgaccctttgccagattctaactggtccagtgcccaatcccattgatagaaactcaaccaatgcaaacctcagcctgcaagctccgaaggggcagagtgcaagccggtagcttttgcctcctggagcccacagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccacgcctcacgtgccatttgttctctgagtttcccatgttctcgcctcctactacctagccctatgctaggactctcccctccaggacacagtagccagcctagctttcccctccccacctgcctctaacaatgggaaacaggcaggtggtaaacaggtgggcagtggaggtggccccatgtctccagcctcccctggaagctcccacccccctcattgttcagtgctctggtcctcctggagtggagacctgcagggcccctccccttcctctgttgacctctcctcactctccaggtgccagttttgctccctgcctcagcctggtttacatacagtgtatgtgacggggcttggtcactgctggggcagccctgtggaaggtggaggggaccgagcatgcatgagcttcaggctgagacagtcccagctcagaaccctggagtgcttgttccctccctttctgctcttcctcttccattgcacccactggacccaagagcatgcaaggattgactcacccagtgatgctagaactatgtattcagctgaaagtaagggggtgggggcatccaaccaggggcagaagatgggaattcaagaaaggaaggtttcccctagaaaacggttttcgtcttttctcttaaatccagatagaataagaagcgaaggccgttacagcagagagaaagttgagtcaagcagagatcagatactaaagacactagactaaccagacattcgggccctcagttgaacagctgaggatgtcagaagatgttaaggaggcaaaattggaaaacttggtggctggcagacagaaatggggggagatgggagcagatgtgagaagatttaaaggcttgtagagcttgggtggtgatttcatccaccaaacctatctctctccccattctggcatacaaggcagcagtcagggtccccagaggcagcccatctttctggcagggacccatgctggagatctggccagctgaaaggccccaaaggagctcggtgccctgggtaatatgggaaggtgctccatggcactgccctcacatggaggccacagaagcccctgaatggctgctgcaattggtaacggggacacctgttcaactgaaatatctcctaccctgagatgggtcctttctccaagggatctttacaattacatttgtccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacttccgggacgaggagctgtcctgcaccgtggtggagctgaagtacacaggcaatgccagcgcactcttcatcctccctgatcaagacaagatggaggaagtggaagccatgctgctcccagagaccctgaagcggagttgagaatggagagaatgttacctctcctgactctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagctccctgaggcagagttgagaatggagagaatgttacctctcctgactctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacacgttgcttgtgcctttccatgctgactatcagactctgcgcccctgaggctacctgtgccccaaagacaagccccttgagctcccatgcaggctcagctccaccccaagatctgggctccttctgccttcagctgcagcagcctgcccaggactacctaagcttgtggccaagctcacccagacctcaggcccagggttgggaggggaccctgctgctctaaggccaattcctgccccccaggcttctgggtgcccactttcagtttctctccttccacccccagggcccaggctccacctggctctttccagagctcctagccctgaccacatctggcacagcccccggactccttgctcctgcagctgtgcagggctttatcatgcgacatccttcttctgccctttagcacccccaatttgggggaagtagctactttctgggtttccagatggagcccctcaactgcctcaccagttcctagcctggctctg

SEQ ID NO: 1127 - DNA, 1742 bp, Homo sapiens
  misc_feature: Incyte ID No: 418391.2
  unsure 53: a, t, c, g, or other
ttttgcacacacaaacactgtaggacgctcgtcttcactactgcatccccganccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgcttggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatcttatgcacagcctgtgctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtagaacatacctcatgttggatttatcaaaacacactttcattgtggtatatatttaaaagtcaagctttaatactgtggccatgtgtaattgaaagattgaaccaagcatgccattttagctaattaa

SEQ ID NO: 1128 - DNA, 481 bp, Homo sapiens
  misc_feature: Incyte ID No: 480630.21
agaaaaagtatcttcaaaaatgttctgacgtaatctgtgctgcctagcattttgttctccaagctgagtggaataatgcctttcatttacatgttaaatggaagcctatttttaggctaaatgtaagtcttaaagtactgagcagaaatatcttccacatcctattgttgcattaaatccctactgatattttaatggtaattgtgatagtacctgaataactattgtgtaagaataaagttaatgtaaaaaaatttttaagtgtgtagtcttactgagtacatttgcttttcatggtatcttttctctgtttatattcaagttttatgagcaatatgatgatgatgaaattggagctctggataatgcagaattggaaggttctattcaagtggacagcaatcgcttacaggaagttttgaatgactactataaagagaaggcagagaagtatagtgacttttccttccttgtttagctg

SEQ ID NO: 1129 - DNA, 1026 bp, Homo sapiens
  misc_feature: Incyte ID No: 117799.1
  unsure 85, 155: a, t, c, g, or other
ccggggcctgcctcccatcccgctccgctggggttcagagcgttccgtgaggaggtaagcgctagggcaggagaggccgacaganaccccggggcccgccgctccttgaggccggggttggggagggcaggggccgtcggctctcccagccagangccgcgtggttttgggggacgtcttgactctgagtcctgcagccagggccccatccgcgggctcagaccagcagccccaagcccccctctgcccagggagcctcaggagcaggatgagtcgagagtcgacgccggacacggcccgcccctgcttcctactctcacccccaggcctggctgggggccggcagcccccacgcccacggttggtttgttcagggagagaaaacggctttcccagctctactcacctcacttcaccctcagagagtcggggcggagtgagggtgaggagcctggtccagggtccccacctcggaagcatttagagatgtaaactttgatcctttgatcatttaacctgctcagcacagcaggaagtgggaacttggtccctaccccagtccccagggcctttggagggaagggttggacagtttggaggccagcagaccccttggggacagcttaatgtatctgaagattcctgagtgggaatgttgctggagggcaagctgcttctcttttttaaaaattcattttctctagcagctgttttggcccctttggtgtccctgagctccccatggcactgtttcctgccgtgactttctcctcctggacactggagcccaggtggtgcccgcgcacctctcacacactgggggatagggtcaaggcctcatccaagtctgttaacagcttcccactcaaccagtctccccaaaatacactgtgagttcaatgattctgcttataaaggagtgctatgaaactgacctattttcctaattggttaactgacttcatctcacataaccttgagtaaccaagccttcatcagagcggacgatccaacccaacatgctgt

SEQ ID NO: 1130 - DNA, 682 bp, Homo sapiens
  misc_feature: Incyte ID No: 235194.15
catggtgccagtcgcaccccttccccgccgcgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacagtttaaaagcaagttcatgaattcgcgtgccgtgtgcacggagagaggccgtagttcctggggctggagctagtccaggaggacagtgaagatgtcgccttccttagtcccccggcctgtgagcaagaggaagctgcagaccactcgggccaccctcacccagacacctttagcaaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcctggctgtctgg

SEQ ID NO: 1131 - DNA, 301 bp, Homo sapiens
  misc_feature: Incyte ID No: 379400.1
  unsure 38: a, t, c, g, or other
agagaaggttagcactccccttgacaaggatggaagangccctcgggcctgacaacacgcatacggttaaggcattgccacctacttcgtggcatctaaccatcgtttttacataggtttagaatagtgaacattgcattgtgatctagattggttaagaaagaggacaaagtaattatgaatctattggtagtgcatggtcagaactgaacttctaaggtactttttagctaacctaaagcttatttaatgggagacaacacaaagcagagttacatatccttagaccagttttgccatt

SEQ ID NO: 1132 - DNA, 281 bp, Homo sapiens
  misc_feature: Incyte ID No: 380433.1
acatctaggcccctcgcaatactagctgcttggccacttcgcagagactgaaatgaaaggctctactgcaggaacatttgaaggaactttctttggggggcggtgggggctatcagcgaagggaggggaatgtgcgtggagctgaggaggagcctcccggctctccgagggccttggggttgggatccctaggtgcagcccgttgacagtcggccccacggccatggacgtcctttccccaagttagctgagcgcctgccaccgagatcccccgagtccta

SEQ ID NO: 1133 - DNA, 3597 bp, Homo sapiens
  misc_feature: Incyte ID No: 140122.22
  unsure 3575: a, t, c, g, or other
gcggggggcggtggggaccgtgggactcgccgcgaggtcgcgaggggtcgcggggggcggtcagggcccggcccggggcgggccgcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacattgagacaaaaaaccttgcaaaacattggtatacataaaggctgatcacgtgactactgtcgtccaaataatacataagtatccaaacctgtttccatgggaataggtttgtaagcttgcggtaacatcggacttaaatacacttttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgatttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattcatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatataataaaatagtactntgattaatggttgtcgttcatg

SEQ ID NO: 1134 - DNA, 367 bp, Homo sapiens
  misc_feature: Incyte ID No: 131931.1
ttcaaacctaaggcaagtaatattttaaatgatagaatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaggaaagtaatcatggaaacatatgttttttccctggtggtctagtggtta

SEQ ID NO: 1135 - DNA, 717 bp, Homo sapiens
  misc_feature: Incyte ID No: 381058.1
cggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatagctaagtccttgggtagcgccagtgccaaataacccgttcgcctttttttctctgaaaatgttcccccaaaatggaggatttcgcagactctgaagagcctgcttgtttgagcagcgtttctttcttttcccggtgtctcggccttcacgccgctccttgcccatcgcctcagagcgccccctaagactcccggcccacacgcgcgcgcgcgcggcgttagctggacatcagaaacaattcctccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccagag

SEQ ID NO: 1136 - DNA, 162 bp, Homo sapiens
  misc_feature: Incyte ID No: 403136.1
  unsure 10, 12, 14, 22-23, 28: a, t, c, g, or other
ctgcatgctntncnaagaaccnnttgancaatatcaagaatctggttatctgagaacttctgttagcctctcagctcagctctatttatcttaggagttaatttgccttctctccccatctccctcagtcccataaaaccttcattacacataaagaacacg

SEQ ID NO: 1137 - DNA, 872 bp, Homo sapiens
  misc_feature: Incyte ID No: 276647.1
ccggatcctctagagatccctcgacctcgacccacgcgtccgcaaaaatgttagcagttaataaatctcaatggtagagatagagggagttacatattatttacttttcagtgtttgaaaattttcttaataaaaatttgtataggtttaagaaagaaaaagtgaatagctgattatcatttttcttcacttaagaactttaaacacagaatttaaatttttcatattttttgaaaattaacatatatttattacagtgccaaatctcatgagtccctgtctcataatctaagaccaggctactctgaaagaggacagagttcactgcctaatccaacactggctgtagtgtaaatgcaacacaggtgatttttgccccagttccaaggctacctaactagctatgtgggccttagtcacccttaaaggaagatggttgcaactatgccagttagaacatttttctgctctgcttccacagtggcactccacaagaggaggacttgattttatagcttgtgtacaggagaatataaagttggcttcaaaggaggtaggataggtttggcatttttctcctcataatgtttcctgaagcatgaaaggatccttgatcagaagagtgctcagttctaatttctaaaatttgctggcttaatatttttaaagattcaattctccatatgagtaagttagcgtgtatcatcaaaaactatctagaactgtgtgcagagactgttactggttttccaagttgtatatttttgagtatcttaaaatatttcatcaactttctaaaacatcaagaaaagctctctatacaaataccatggttgattttaattattttgtgttccatccttttaaaaata

SEQ ID NO: 1138 - DNA, 303 bp, Homo sapiens
  misc_feature: Incyte ID No: 191631.1
ccggatcctctagagatccctcgacctcgacccacgcgtccgcaatattcctaaacttgtcctttatgatctaataattttaaaaatgaaactaattgttgttctttccattgtttgaaaaatggaaaatgataatattacagaaaacagtaaagacattgaactgtttaaaaaaaaaaaaatgaccagccttccggggacttaccatcctctttgcctctttgctgaaatccctatgggttccccaccatttttgggcttgaaatatgtattgggtcagctttagtccagccaacaagttga

SEQ ID NO: 1139 - DNA, 1166 bp, Homo sapiens
  misc_feature: Incyte ID No: 887619.26
cccttttttttttttttggattgcaaaaatttattaaaattggagacactgttttaatcttcttgtgccatgagactccatcaggcagtctacaaagaccactgggaggctgaggatcacttgagccccagaagtttgaggctgtagtaagcttcaaaggccactgcactctagcttgggtgaggcaagaccctttcaagcagtaagctgcatgcttgcttgttgtggtcattaaaaaccctagtttaggataacaggtctgcctgcatttcttcaatcatgaattctgagtcctttgcttctttaaaacttgctccacacagtgtagtcaagccgactctccatacctttaaaaggtatgacaggaactgtcttcatgtccttacccaagcaagtcatccatggataaaaacgttaccaggagcagaaccattaagctggtccaggcaagttggactccaccatttcaacttccagctttctgtctaatgcctgtgtgccaatggcttgagttaggcttgctctttaggacttcagtagctattctcgtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggacatgaagaccgttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcc

SEQ ID NO: 1140 - DNA, 481 bp, Homo sapiens
  misc_feature: Incyte ID No: 980953.1
ctgtgcgcctaggagtggggacggcggtggcggggtcatgcagcgctcccagccaccctgcggccgggtcccagccagcagcaccatgccagcggccggaggcgtgggctgggggccggggcaccgtcccggaaaaccgggcgcgccccaaggtccctgcttctcgcttccgcgtccccagagaagccgtagctcccgcccccagcccggcagaaacctcctttctttacattattaagtttgttttcattttaattttcttaggacattgataaaatcactttcggatttttgagattaaaaattaaataattttcatctttaccctttttaaatttttcacactttattttaatgcttttattcttttgtaaattttaattattgtaatttatatcttcaattattatggaagaattttagaaaagtcttttcacataataaagactaattaatgaactattaaaaaaaaaaaaaaagg

SEQ ID NO: 1141 - DNA, 283 bp, Homo sapiens
  misc_feature: Incyte ID No: 389859.1
gcctcaggctctgcctgtcaccttgaagacatccatgtgggtcccctcagggcttctctttgccataaaaataaaatgattgctcccaccaatgtttgcgtccatgggagaggaggtaggagcagcagtacttgtcctgtgtgtgggagacacttgaagggctcagtgggaattgtcagcagcagggaacagaacaggtggtgagaagagtcattccactgagtttctgggcctttgactccctgaaacttccttctcctctatccaacctccctctccagac

SEQ ID NO: 1142 - DNA, 640 bp, Homo sapiens
  misc_feature: Incyte ID No: 217281.1
caagaacatttgagtaatgcattgcatcacaatattaggatggctacgacgtccacaggcaataggaattttttagctccattataatcttgagaccaccatcacatatgcagtctgtgattaaccaaaacattgttaggtgatacatgaccatataatttattcactatgtgtaacacaaagctccctaaaatatggatcctgccatcagggccttacaatgctgacattgataatgggcatatgagtgaaagaatagtttagtcttaagtatcaggtgctgtgagagatacaaagggaataaaaagcagtttctgtcctccaggagctctttcatcttcttgggaagaaaaaagatttcaaaccttttgctccagccacaattcagagagcccctgaatgagccatatacctttgcagatggtattttcctttcctgaaactgcccttgtgagtttagtaagctccaaccttggtaactcagctcaaaacatcatcatctctctgctctcaaaatcaacacttgcctcaatgaaaagacttaaatattgcatattgattggctggcctttccataaactgtaagctctttgaatatagggtgtttgtcttagattctcaataaatgcttcttgaagtg

SEQ ID NO: 1143 - DNA, 547 bp, Homo sapiens
  misc_feature: Incyte ID No: 032428.1
  unsure 370-372: a, t, c, g, or other
ggaatactctgattttttagcctgtcattggttggatggtgaagcaggcaacaaaaatgggggggcctgggcaaagattagggggggggagccaagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcannnatcttttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtg

What is claimed is:

1. A combination comprising a plurality of cDNAs wherein the plurality of cDNAs are differentially expressed in response to steroid treatment and consist of the nucleic acid sequences of SEQ ID NOs:1–3, 5, 6, 8, 9, 11–14, 16–18, 20, 21, 23–34, 36, 38–40, 42–50, 52–63, 65, 66, 68–71, 73–75, 77–84, 86–111, 113–115, 117–126, 128–142, 145–160, 162–164, 166, 167, 169–172, 174–176, 178–186, 188–197, 199–202, 204–211, 213, 215, 217–228, 230–246, 248–251, 253–259, 261–266, 268–277, 279, 281, 283, 284, 286, 288–292, 294, 295, 297–300, 302–308, 310, 311, 313, 315–320, 322, 323, 325, 327–346, 348–350, 352–357, 359–368, 370–372, 374, 376, 378, 380–389, 391–400, 402, 403, 405–413, 415, 416, 418, 420, 422–426, 428, 429, 431–446, 448, 450–453, 455, 457, 459, 461, 463–466, 468–470, 472–478, 480–488, 490–492, 494–502, 504–506, 508–520, 522–526, 528–530, 532, 534, 535, 537–561, 563–565, 567, 569–575, 577, 579–581, 583, 585–589, 591–614, 616, 618, 619, 621, 623, 625, 627, 629–641, 643, 645–654, 656–663, 665–680, 682–698, 700–708, 710, 712–720, 722–725, 727–730, 732, 734, 735, 737–741, 743–754, 756, 758–768, 770–780, 782–786, 788–792, 794, 796–802, 804–806, 808, 809, 811–814, 816, 817, 819–829, 831, 833, 835, 836, 838–840, 842–888, 890–892, 894–908, 910, 912, 914–927, 929, 930, 932–937, 939–944, 946, 948–957, 959–964, 966–976, 978–988, 990–999, 1001–1008, 1010–1028, 1030–1034, 1036–1085, 1087–1096, 1098–1143 or a plurality of cDNAs consisting of the complements thereof.

2. The combination of claim 1, wherein the cDNAs are immobilized on a substrate.

3. A high throughput method for using a cDNA to detect differential expression of nucleic acids in a sample, the method comprising:

a) hybridizing the combination of claim 1 with nucleic acids of the sample, thereby forming one or more hybridization complexes;

b) detecting the hybridization complexes; and c) comparing the hybridization complexes with those of a standard, wherein differences between the standard and sample hybridization complexes indicate differential expression of cDNAs in the sample.

4. The method of claim 3, where in the nucleic acids of the sample are amplified prior to hybridization.

5. The method of claim 3, wherein the sample is from a subject with Wilson disease and comparison with a standard defines a stage of that disease.

6. A high throughput method of screening a plurality of molecules or compounds to identify a ligand which specifically binds a cDNA, the method comprising:

a) combining the combination of claim 1 with the plurality of molecules or compounds under conditions to allow specific binding; and b) detecting specific binding between each cDNA and at least one molecule or compound, thereby identifying a ligand that specifically binds to each cDNA.

7. The method of claim 6 wherein the plurality of molecules or compounds are regulatory proteins.

* * * * *